United States Patent 6,821,724 (METHODS OF GENETIC ANALYSIS USING NUCLEIC ACID ARRAYS) - sequence listing, part 4

SEQ ID NO: 106509 - DNA, 25 bp, mus musculus
agcctccggcatctgcattatcctc

SEQ ID NO: 106510 - DNA, 25 bp, mus musculus
ctccggcatctgcattatcctcaac

SEQ ID NO: 106511 - DNA, 25 bp, mus musculus
ctgcattatcctcaacgtggcggag

SEQ ID NO: 106512 - DNA, 25 bp, mus musculus
gatcaacaagctgctgagcgagcag

SEQ ID NO: 106513 - DNA, 25 bp, mus musculus
agacatactgcgccgcagccctggc

SEQ ID NO: 106514 - DNA, 25 bp, mus musculus
gagcgaccgatgctcagcctgctga

SEQ ID NO: 106515 - DNA, 25 bp, mus musculus
ctcagcctgctgatgccagtaccag

SEQ ID NO: 106516 - DNA, 25 bp, mus musculus
agcctgctgatgccagtaccaggca

SEQ ID NO: 106517 - DNA, 25 bp, mus musculus
caccccgagtagcatctgtccaggt

SEQ ID NO: 106518 - DNA, 25 bp, mus musculus
cccgagtagcatctgtccaggtggt

SEQ ID NO: 106519 - DNA, 25 bp, mus musculus
acagaaggcggctgcttggtgctaa

SEQ ID NO: 106520 - DNA, 25 bp, mus musculus
tgcttggtgctaacatccgagtccg

SEQ ID NO: 106521 - DNA, 25 bp, mus musculus
ttggtgctaacatccgagtccgagt

SEQ ID NO: 106522 - DNA, 25 bp, mus musculus
gtgctaacatccgagtccgagtcga

SEQ ID NO: 106523 - DNA, 25 bp, mus musculus
ctaacatccgagtccgagtcgatct

SEQ ID NO: 106524 - DNA, 25 bp, mus musculus
acatccgagtccgagtcgatctacg

SEQ ID NO: 106525 - DNA, 25 bp, mus musculus
gagtccgagtcgatctacgagacaa

SEQ ID NO: 106526 - DNA, 25 bp, mus musculus
atctacgagacaactactccccagg

SEQ ID NO: 106527 - DNA, 25 bp, mus musculus
tacgagacaactactccccaggctg

SEQ ID NO: 106528 - DNA, 25 bp, mus musculus
tcaaccactgggaactcaagggagt

SEQ ID NO: 106529 - DNA, 25 bp, mus musculus
tggtagtcattccctgtggaatcac

SEQ ID NO: 106530 - DNA, 25 bp, mus musculus
tagtcattccctgtggaatcacaaa

SEQ ID NO: 106531 - DNA, 25 bp, mus musculus
tcattccctgtggaatcacaaatgc

SEQ ID NO: 106532 - DNA, 25 bp, mus musculus
ttccctgtggaatcacaaatgccct

SEQ ID NO: 106533 - DNA, 25 bp, mus musculus
gaatcacaaatgccctgtctgaaga

SEQ ID NO: 106534 - DNA, 25 bp, mus musculus
tcacaaatgccctgtctgaagaaga

SEQ ID NO: 106535 - DNA, 25 bp, mus musculus
caaatgccctgtctgaagaagacag

SEQ ID NO: 106536 - DNA, 25 bp, mus musculus
atgccctgtctgaagaagacagaga

SEQ ID NO: 106537 - DNA, 25 bp, mus musculus
gtcagcaactgcaagcaaactgcta

SEQ ID NO: 106538 - DNA, 25 bp, mus musculus
aactgcaagcaaactgctaggcagg

SEQ ID NO: 106539 - DNA, 25 bp, mus musculus
gatttctgtatcccttagcccctca

SEQ ID NO: 106540 - DNA, 25 bp, mus musculus
actgaggcagtcccttgcagaacca

SEQ ID NO: 106541 - DNA, 25 bp, mus musculus
gcagtcccttgcagaaccactgtca

SEQ ID NO: 106542 - DNA, 25 bp, mus musculus
tcctgcttttctgaattagtcaaga

SEQ ID NO: 106543 - DNA, 25 bp, mus musculus
tgtctttcagatactggccagagcc

SEQ ID NO: 106544 - DNA, 25 bp, mus musculus
actggccagagcctggacactcttc

SEQ ID NO: 106545 - DNA, 25 bp, mus musculus
cagagcctggacactcttcctctga

SEQ ID NO: 106546 - DNA, 25 bp, mus musculus
actcttcctctgagatctccagctt

SEQ ID NO: 106547 - DNA, 25 bp, mus musculus
cctctgagatctccagcttctctgc

SEQ ID NO: 106548 - DNA, 25 bp, mus musculus
agatctccagcttctctgccttctt

SEQ ID NO: 106549 - DNA, 25 bp, mus musculus
actgctaggcaggattcagaagaaa

SEQ ID NO: 106550 - DNA, 25 bp, mus musculus
gcatctctaacatccaccaggaagg

SEQ ID NO: 106551 - DNA, 25 bp, mus musculus
tccaccaggaaggtgcccagaaaag

SEQ ID NO: 106552 - DNA, 25 bp, mus musculus
cctctttctgagacaatccactatt

SEQ ID NO: 106553 - DNA, 25 bp, mus musculus
tctgagacaatccactatttgaaaa

SEQ ID NO: 106554 - DNA, 25 bp, mus musculus
acaatccactatttgaaaattgtag

SEQ ID NO: 106555 - DNA, 25 bp, mus musculus
gaattgcctctcagtatgcgagctg

SEQ ID NO: 106556 - DNA, 25 bp, mus musculus
gatcactttgccttagggccactag

SEQ ID NO: 106557 - DNA, 25 bp, mus musculus
gcactttgggcaggcacccctgcgc

SEQ ID NO: 106558 - DNA, 25 bp, mus musculus
cactttgggcaggcacccctgcgca

SEQ ID NO: 106559 - DNA, 25 bp, mus musculus
cttcagtctggtaccacagccagat

SEQ ID NO: 106560 - DNA, 25 bp, mus musculus
ttcagtctggtaccacagccagatc

SEQ ID NO: 106561 - DNA, 25 bp, mus musculus
cagtctggtaccacagccagatcga

SEQ ID NO: 106562 - DNA, 25 bp, mus musculus
agtctggtaccacagccagatcgag

SEQ ID NO: 106563 - DNA, 25 bp, mus musculus
tctggtaccacagccagatcgagtg

SEQ ID NO: 106564 - DNA, 25 bp, mus musculus
ctggtaccacagccagatcgagtgc

SEQ ID NO: 106565 - DNA, 25 bp, mus musculus
agatcgagtgcttcacgccagcaca

SEQ ID NO: 106566 - DNA, 25 bp, mus musculus
gatcgagtgcttcacgccagcacat

SEQ ID NO: 106567 - DNA, 25 bp, mus musculus
ctatgactacgagggagatggtctg

SEQ ID NO: 106568 - DNA, 25 bp, mus musculus
tatgactacgagggagatggtctgt

SEQ ID NO: 106569 - DNA, 25 bp, mus musculus
cagggatgcacccttcagtctggta

SEQ ID NO: 106570 - DNA, 25 bp, mus musculus
agggatgcacccttcagtctggtac

SEQ ID NO: 106571 - DNA, 25 bp, mus musculus
ggatgcacccttcagtctggtacca

SEQ ID NO: 106572 - DNA, 25 bp, mus musculus
gatgcacccttcagtctggtaccac

SEQ ID NO: 106573 - DNA, 25 bp, mus musculus
tgcacccttcagtctggtaccacag

SEQ ID NO: 106574 - DNA, 25 bp, mus musculus
gcacccttcagtctggtaccacagc

SEQ ID NO: 106575 - DNA, 25 bp, mus musculus
acccttcagtctggtaccacagcca

SEQ ID NO: 106576 - DNA, 25 bp, mus musculus
cccttcagtctggtaccacagccag

SEQ ID NO: 106577 - DNA, 25 bp, mus musculus
gaaaccctgtagtggattgtaagag

SEQ ID NO: 106578 - DNA, 25 bp, mus musculus
ttactcgaaagcccaatgaaagaag

SEQ ID NO: 106579 - DNA, 25 bp, mus musculus
acttacttctgagagtgcgtttgag

SEQ ID NO: 106580 - DNA, 25 bp, mus musculus
ttctgagagtgcgtttgaggcactt

SEQ ID NO: 106581 - DNA, 25 bp, mus musculus
ggcacttatggcttactaagcagtg

SEQ ID NO: 106582 - DNA, 25 bp, mus musculus
agcagtgtgtcaccatacttgaaaa

SEQ ID NO: 106583 - DNA, 25 bp, mus musculus
agtgtgtcaccatacttgaaaactc

SEQ ID NO: 106584 - DNA, 25 bp, mus musculus
gtgtcaccatacttgaaaactcttc

SEQ ID NO: 106585 - DNA, 25 bp, mus musculus
tacttgaaaactcttccatttattg

SEQ ID NO: 106586 - DNA, 25 bp, mus musculus
ttgaaaactcttccatttattgtat

SEQ ID NO: 106587 - DNA, 25 bp, mus musculus
actcttccatttattgtatctggat

SEQ ID NO: 106588 - DNA, 25 bp, mus musculus
ccatttattgtatctggatgaggct

SEQ ID NO: 106589 - DNA, 25 bp, mus musculus
ctcgaaagcccaatgaaagaagtat

SEQ ID NO: 106590 - DNA, 25 bp, mus musculus
gtatctgcttatttacaatctttga

SEQ ID NO: 106591 - DNA, 25 bp, mus musculus
tctgcttatttacaatctttgaagc

SEQ ID NO: 106592 - DNA, 25 bp, mus musculus
ccaatgtttgccaattttggtgaat

SEQ ID NO: 106593 - DNA, 25 bp, mus musculus
tcatttttctagacttttctcgagg

SEQ ID NO: 106594 - DNA, 25 bp, mus musculus
tagacttttctcgaggttttcatgg

SEQ ID NO: 106595 - DNA, 25 bp, mus musculus
tcaccctctatgatgacttacttct

SEQ ID NO: 106596 - DNA, 25 bp, mus musculus
atgatgacttacttctgagagtgcg

SEQ ID NO: 106597 - DNA, 25 bp, mus musculus
accatcagcctgtgctgctgggact

SEQ ID NO: 106598 - DNA, 25 bp, mus musculus
tgctgctgggactccaggacagctg

SEQ ID NO: 106599 - DNA, 25 bp, mus musculus
atcgtgcgctgcatagtgcactccc

SEQ ID NO: 106600 - DNA, 25 bp, mus musculus
accaaccctggcttcatgacgtgca

SEQ ID NO: 106601 - DNA, 25 bp, mus musculus
cctggcttcatgacgtgcagcgatg

SEQ ID NO: 106602 - DNA, 25 bp, mus musculus
ttctggtaccggagtccactactga

SEQ ID NO: 106603 - DNA, 25 bp, mus musculus
tggtaccggagtccactactgactg

SEQ ID NO: 106604 - DNA, 25 bp, mus musculus
agtccactactgactgaactggccc

SEQ ID NO: 106605 - DNA, 25 bp, mus musculus
ccactactgactgaactggccccat

SEQ ID NO: 106606 - DNA, 25 bp, mus musculus
ccatcctagggttcttgtctcagga

SEQ ID NO: 106607 - DNA, 25 bp, mus musculus
ggttcttgtctcaggactctgccct

SEQ ID NO: 106608 - DNA, 25 bp, mus musculus
tcttgtctcaggactctgccctcct

SEQ ID NO: 106609 - DNA, 25 bp, mus musculus
tgctgggactccaggacagctgagc

SEQ ID NO: 106610 - DNA, 25 bp, mus musculus
gactccaggacagctgagcgcagga

SEQ ID NO: 106611 - DNA, 25 bp, mus musculus
tccaggacagctgagcgcaggaacc

SEQ ID NO: 106612 - DNA, 25 bp, mus musculus
aacctgctgtccctgggccacaaca

SEQ ID NO: 106613 - DNA, 25 bp, mus musculus
ctgtccctgggccacaacaacatcg

SEQ ID NO: 106614 - DNA, 25 bp, mus musculus
ctgggccacaacaacatcgtgcgct

SEQ ID NO: 106615 - DNA, 25 bp, mus musculus
ggccacaacaacatcgtgcgctgca

SEQ ID NO: 106616 - DNA, 25 bp, mus musculus
aacatcgtgcgctgcatagtgcact

SEQ ID NO: 106617 - DNA, 25 bp, mus musculus
ggatccatgggctgatctggaagta

SEQ ID NO: 106618 - DNA, 25 bp, mus musculus
ccaacctgttgtgatcttcagtaga

SEQ ID NO: 106619 - DNA, 25 bp, mus musculus
ttttccttgtttgccgcctgacact

SEQ ID NO: 106620 - DNA, 25 bp, mus musculus
tccttgtttgccgcctgacacttct

SEQ ID NO: 106621 - DNA, 25 bp, mus musculus
tttgccgcctgacacttctcagcag

SEQ ID NO: 106622 - DNA, 25 bp, mus musculus
gccgcctgacacttctcagcaggat

SEQ ID NO: 106623 - DNA, 25 bp, mus musculus
gcctgacacttctcagcaggatcca

SEQ ID NO: 106624 - DNA, 25 bp, mus musculus
cacttctcagcaggatccacatacc

SEQ ID NO: 106625 - DNA, 25 bp, mus musculus
ttctcagcaggatccacatacccta

SEQ ID NO: 106626 - DNA, 25 bp, mus musculus
tcagcaggatccacataccctaagg

SEQ ID NO: 106627 - DNA, 25 bp, mus musculus
gcaggatccacataccctaaggagt

SEQ ID NO: 106628 - DNA, 25 bp, mus musculus
ggatccacataccctaaggagtgga

SEQ ID NO: 106629 - DNA, 25 bp, mus musculus
cagtagacaaacactcctggtgtgt

SEQ ID NO: 106630 - DNA, 25 bp, mus musculus
tagacaaacactcctggtgtgtcac

SEQ ID NO: 106631 - DNA, 25 bp, mus musculus
tcacaggattcagctctgtttccta

SEQ ID NO: 106632 - DNA, 25 bp, mus musculus
cggctgtctcctggaatgaagaaag

SEQ ID NO: 106633 - DNA, 25 bp, mus musculus
ggcactctgagagctgccatctttt

SEQ ID NO: 106634 - DNA, 25 bp, mus musculus
ctgagagctgccatcttttccttgt

SEQ ID NO: 106635 - DNA, 25 bp, mus musculus
agagctgccatcttttccttgtttg

SEQ ID NO: 106636 - DNA, 25 bp, mus musculus
gctgccatcttttccttgtttgccg

SEQ ID NO: 106637 - DNA, 25 bp, mus musculus
tggtatcctgctgatggaaattgtc

SEQ ID NO: 106638 - DNA, 25 bp, mus musculus
aattgtcacctatggccggatccct

SEQ ID NO: 106639 - DNA, 25 bp, mus musculus
tcagtgccttgacacgcccaacttg

SEQ ID NO: 106640 - DNA, 25 bp, mus musculus
caacttgctgggcccactctcagac

SEQ ID NO: 106641 - DNA, 25 bp, mus musculus
accacacacactgcagctgttgagt

SEQ ID NO: 106642 - DNA, 25 bp, mus musculus
ggaggacttcacaatctctttctga

SEQ ID NO: 106643 - DNA, 25 bp, mus musculus
cttcacaatctctttctgactctag

SEQ ID NO: 106644 - DNA, 25 bp, mus musculus
aatctctttctgactctagtcatct

SEQ ID NO: 106645 - DNA, 25 bp, mus musculus
gtcatctgcaatccgccactctcag

SEQ ID NO: 106646 - DNA, 25 bp, mus musculus
tggtatgtctcatttgcctggaatg

SEQ ID NO: 106647 - DNA, 25 bp, mus musculus
gtctcatttgcctggaatgactgaa

SEQ ID NO: 106648 - DNA, 25 bp, mus musculus
attcaatctatagctgtgatttaag

SEQ ID NO: 106649 - DNA, 25 bp, mus musculus
ttacccaggtatgtcaaacccagag

SEQ ID NO: 106650 - DNA, 25 bp, mus musculus
gtaccgtatgcctcgaccagataac

SEQ ID NO: 106651 - DNA, 25 bp, mus musculus
tatgcctcgaccagataactgtcca

SEQ ID NO: 106652 - DNA, 25 bp, mus musculus
tcgaccagataactgtccagaagag

SEQ ID NO: 106653 - DNA, 25 bp, mus musculus
cacggccactgagagccagtatcag

SEQ ID NO: 106654 - DNA, 25 bp, mus musculus
gcagcagccttgacagcagtaagga

SEQ ID NO: 106655 - DNA, 25 bp, mus musculus
gcagagccagaagccccatcagtgc

SEQ ID NO: 106656 - DNA, 25 bp, mus musculus
ccagaagccccatcagtgccttgac

SEQ ID NO: 106657 - DNA, 25 bp, mus musculus
gcacgaggccaattcgagtgggaga

SEQ ID NO: 106658 - DNA, 25 bp, mus musculus
cgaggccaattcgagtgggagacga

SEQ ID NO: 106659 - DNA, 25 bp, mus musculus
gtaaacgccctgcagaagatatgga

SEQ ID NO: 106660 - DNA, 25 bp, mus musculus
aacgccctgcagaagatatggaaga

SEQ ID NO: 106661 - DNA, 25 bp, mus musculus
acgccctgcagaagatatggaagag

SEQ ID NO: 106662 - DNA, 25 bp, mus musculus
gaatattaaggctctccgtacagac

SEQ ID NO: 106663 - DNA, 25 bp, mus musculus
atattaaggctctccgtacagacta

SEQ ID NO: 106664 - DNA, 25 bp, mus musculus
ttaaggctctccgtacagactacaa

SEQ ID NO: 106665 - DNA, 25 bp, mus musculus
taaggctctccgtacagactacaat

SEQ ID NO: 106666 - DNA, 25 bp, mus musculus
tccgtacagactacaatgccagtgt

SEQ ID NO: 106667 - DNA, 25 bp, mus musculus
ccgtacagactacaatgccagtgtt

SEQ ID NO: 106668 - DNA, 25 bp, mus musculus
gtacagactacaatgccagtgtttc

SEQ ID NO: 106669 - DNA, 25 bp, mus musculus
aggccaattcgagtgggagacgagc

SEQ ID NO: 106670 - DNA, 25 bp, mus musculus
tacagactacaatgccagtgtttca

SEQ ID NO: 106671 - DNA, 25 bp, mus musculus
ccaattcgagtgggagacgagcacg

SEQ ID NO: 106672 - DNA, 25 bp, mus musculus
caattcgagtgggagacgagcacga

SEQ ID NO: 106673 - DNA, 25 bp, mus musculus
acgagcacgacggcctattggtgga

SEQ ID NO: 106674 - DNA, 25 bp, mus musculus
agcacgacggcctattggtggatcc

SEQ ID NO: 106675 - DNA, 25 bp, mus musculus
tggatccattttcttgaattaaatg

SEQ ID NO: 106676 - DNA, 25 bp, mus musculus
atttggtaaacgccctgcagaagat

SEQ ID NO: 106677 - DNA, 25 bp, mus musculus
tggtaaacgccctgcagaagatatg

SEQ ID NO: 106678 - DNA, 25 bp, mus musculus
agtgcttaggcacaatctagtcttt

SEQ ID NO: 106679 - DNA, 25 bp, mus musculus
tgcttaggcacaatctagtcttttg

SEQ ID NO: 106680 - DNA, 25 bp, mus musculus
gtcactattcatcaccaaatttaag

SEQ ID NO: 106681 - DNA, 25 bp, mus musculus
ctattcatcaccaaatttaagatgt

SEQ ID NO: 106682 - DNA, 25 bp, mus musculus
attcatcaccaaatttaagatgtta

SEQ ID NO: 106683 - DNA, 25 bp, mus musculus
tcatcaccaaatttaagatgttaca

SEQ ID NO: 106684 - DNA, 25 bp, mus musculus
agagaaagttccacacactgagtga

SEQ ID NO: 106685 - DNA, 25 bp, mus musculus
aaagttccacacactgagtgacagt

SEQ ID NO: 106686 - DNA, 25 bp, mus musculus
acataggcatatccacacactgagt

SEQ ID NO: 106687 - DNA, 25 bp, mus musculus
ataggcatatccacacactgagtga

SEQ ID NO: 106688 - DNA, 25 bp, mus musculus
aggcatatccacacactgagtgaca

SEQ ID NO: 106689 - DNA, 25 bp, mus musculus
gcatatccacacactgagtgacagt

SEQ ID NO: 106690 - DNA, 25 bp, mus musculus
taggcacaatctagtcttttggttg

SEQ ID NO: 106691 - DNA, 25 bp, mus musculus
ggcacaatctagtcttttggttgtc

SEQ ID NO: 106692 - DNA, 25 bp, mus musculus
cacaatctagtcttttggttgtcac

SEQ ID NO: 106693 - DNA, 25 bp, mus musculus
caatctagtcttttggttgtcacta

SEQ ID NO: 106694 - DNA, 25 bp, mus musculus
tcttttggttgtcactattcatcac

SEQ ID NO: 106695 - DNA, 25 bp, mus musculus
ttggttgtcactattcatcaccaaa

SEQ ID NO: 106696 - DNA, 25 bp, mus musculus
ggttgtcactattcatcaccaaatt

SEQ ID NO: 106697 - DNA, 25 bp, mus musculus
ttgtcactattcatcaccaaattta

SEQ ID NO: 106698 - DNA, 25 bp, mus musculus
gctcgaaaggcgctgtttgagaagt

SEQ ID NO: 106699 - DNA, 25 bp, mus musculus
aggtcacagagtttcggtgtggcca

SEQ ID NO: 106700 - DNA, 25 bp, mus musculus
aatttctcctccagctggagtgacg

SEQ ID NO: 106701 - DNA, 25 bp, mus musculus
tcctccagctggagtgacggcatgg

SEQ ID NO: 106702 - DNA, 25 bp, mus musculus
agtgacggcatggccttctgtgccc

SEQ ID NO: 106703 - DNA, 25 bp, mus musculus
gccttctgtgccctggtgcactcct

SEQ ID NO: 106704 - DNA, 25 bp, mus musculus
tgtgccctggtgcactccttcttcc

SEQ ID NO: 106705 - DNA, 25 bp, mus musculus
tccttcttccctgatgccttcgact

SEQ ID NO: 106706 - DNA, 25 bp, mus musculus
gatgccttcgactacaatgccctga

SEQ ID NO: 106707 - DNA, 25 bp, mus musculus
gccttcgactacaatgccctgagtc

SEQ ID NO: 106708 - DNA, 25 bp, mus musculus
gactacaatgccctgagtcccacac

SEQ ID NO: 106709 - DNA, 25 bp, mus musculus
aatgccctgagtcccacacaaaggc

SEQ ID NO: 106710 - DNA, 25 bp, mus musculus
ttcggtgtggccagtgccagcagca

SEQ ID NO: 106711 - DNA, 25 bp, mus musculus
ctgagtcccacacaaaggcagaaga

SEQ ID NO: 106712 - DNA, 25 bp, mus musculus
agtgccagcagcatcaaacagatcc

SEQ ID NO: 106713 - DNA, 25 bp, mus musculus
agcatcaaacagatcctgctagagt

SEQ ID NO: 106714 - DNA, 25 bp, mus musculus
cagatcctgctagagtggtgccgca

SEQ ID NO: 106715 - DNA, 25 bp, mus musculus
atcctgctagagtggtgccgcagca

SEQ ID NO: 106716 - DNA, 25 bp, mus musculus
tggtgccgcagcaagactgtgggct

SEQ ID NO: 106717 - DNA, 25 bp, mus musculus
tgccgcagcaagactgtgggctatc

SEQ ID NO: 106718 - DNA, 25 bp, mus musculus
cagcacgtggacctgcagaatttct

SEQ ID NO: 106719 - DNA, 25 bp, mus musculus
gggccttccaaggtgcagctggact

SEQ ID NO: 106720 - DNA, 25 bp, mus musculus
ccttccaaggtgcagctggactgtc

SEQ ID NO: 106721 - DNA, 25 bp, mus musculus
attgtgggcagtcccttcaaagcaa

SEQ ID NO: 106722 - DNA, 25 bp, mus musculus
cggttgtctggaggccacagcttca

SEQ ID NO: 106723 - DNA, 25 bp, mus musculus
ttgtctggaggccacagcttcacga

SEQ ID NO: 106724 - DNA, 25 bp, mus musculus
ggaggccacagcttcacgaaacatc

SEQ ID NO: 106725 - DNA, 25 bp, mus musculus
ggccacagcttcacgaaacatccac

SEQ ID NO: 106726 - DNA, 25 bp, mus musculus
cacagcttcacgaaacatccacagt

SEQ ID NO: 106727 - DNA, 25 bp, mus musculus
ttcacgaaacatccacagttctggt

SEQ ID NO: 106728 - DNA, 25 bp, mus musculus
acgaaacatccacagttctggtgga

SEQ ID NO: 106729 - DNA, 25 bp, mus musculus
ccacagttctggtggagacggtgac

SEQ ID NO: 106730 - DNA, 25 bp, mus musculus
cggtgaccaagtcctcctcgagccg

SEQ ID NO: 106731 - DNA, 25 bp, mus musculus
aaggtgcagctggactgtcgggaat

SEQ ID NO: 106732 - DNA, 25 bp, mus musculus
catgtagtcacttacactcccatgg

SEQ ID NO: 106733 - DNA, 25 bp, mus musculus
cctggtaactacctcattgctatca

SEQ ID NO: 106734 - DNA, 25 bp, mus musculus
ggtaactacctcattgctatcaagt

SEQ ID NO: 106735 - DNA, 25 bp, mus musculus
attgctatcaagtatggtggccctc

SEQ ID NO: 106736 - DNA, 25 bp, mus musculus
tatggtggccctcagcacattgtgg

SEQ ID NO: 106737 - DNA, 25 bp, mus musculus
ggccctcagcacattgtgggcagtc

SEQ ID NO: 106738 - DNA, 25 bp, mus musculus
cctcagcacattgtgggcagtccct

SEQ ID NO: 106739 - DNA, 25 bp, mus musculus
caccagtccttggacgattctgtgg

SEQ ID NO: 106740 - DNA, 25 bp, mus musculus
tccttggacgattctgtggcagtaa

SEQ ID NO: 106741 - DNA, 25 bp, mus musculus
agctggtgttccagaccttcgaggt

SEQ ID NO: 106742 - DNA, 25 bp, mus musculus
agctctttgatggctacgacagcac

SEQ ID NO: 106743 - DNA, 25 bp, mus musculus
gctacgacagcacagctcccagact

SEQ ID NO: 106744 - DNA, 25 bp, mus musculus
cagctcccagactggggcgctactg

SEQ ID NO: 106745 - DNA, 25 bp, mus musculus
ccagactggggcgctactgtggttc

SEQ ID NO: 106746 - DNA, 25 bp, mus musculus
ctcccgaggaagtgtactcggctgg

SEQ ID NO: 106747 - DNA, 25 bp, mus musculus
tgtactcggctggagattctgtcct

SEQ ID NO: 106748 - DNA, 25 bp, mus musculus
gagattctgtcctggtgaagttcca

SEQ ID NO: 106749 - DNA, 25 bp, mus musculus
agttccactctgacgacaccatctc

SEQ ID NO: 106750 - DNA, 25 bp, mus musculus
tgcggtacacaagcaccaagttcca

SEQ ID NO: 106751 - DNA, 25 bp, mus musculus
agaagcctgagccagtcctggctac

SEQ ID NO: 106752 - DNA, 25 bp, mus musculus
tggctacaggcaaccgcatgttctt

SEQ ID NO: 106753 - DNA, 25 bp, mus musculus
caggcaaccgcatgttcttgcgctt

SEQ ID NO: 106754 - DNA, 25 bp, mus musculus
accgcatgttcttgcgcttctactc

SEQ ID NO: 106755 - DNA, 25 bp, mus musculus
tgttcttgcgcttctactcagacaa

SEQ ID NO: 106756 - DNA, 25 bp, mus musculus
cagacaactcggtacagaggaaagg

SEQ ID NO: 106757 - DNA, 25 bp, mus musculus
cccatgcccagttcggcgataacaa

SEQ ID NO: 106758 - DNA, 25 bp, mus musculus
tcatcgtggccgaggaaggctatgg

SEQ ID NO: 106759 - DNA, 25 bp, mus musculus
agtgctctggaggctatcctgctgc

SEQ ID NO: 106760 - DNA, 25 bp, mus musculus
gtgctctggaggctatcctgctgct

SEQ ID NO: 106761 - DNA, 25 bp, mus musculus
cacgccatgatctaagccagaaggg

SEQ ID NO: 106762 - DNA, 25 bp, mus musculus
cgccatgatctaagccagaaggggc

SEQ ID NO: 106763 - DNA, 25 bp, mus musculus
ggcggcaccgaaacgccctgtgtgc

SEQ ID NO: 106764 - DNA, 25 bp, mus musculus
gcggcaccgaaacgccctgtgtgcc

SEQ ID NO: 106765 - DNA, 25 bp, mus musculus
gcaccgaaacgccctgtgtgcctta

SEQ ID NO: 106766 - DNA, 25 bp, mus musculus
caccgaaacgccctgtgtgccttag

SEQ ID NO: 106767 - DNA, 25 bp, mus musculus
cgaaacgccctgtgtgccttaggag

SEQ ID NO: 106768 - DNA, 25 bp, mus musculus
gaaacgccctgtgtgccttaggagt

SEQ ID NO: 106769 - DNA, 25 bp, mus musculus
aaacgccctgtgtgccttaggagtg

SEQ ID NO: 106770 - DNA, 25 bp, mus musculus
ttcttgtaagacatcccatttaata

SEQ ID NO: 106771 - DNA, 25 bp, mus musculus
tgctctggaggctatcctgctgctg

SEQ ID NO: 106772 - DNA, 25 bp, mus musculus
ttaataaagtctcatgctgagagag

SEQ ID NO: 106773 - DNA, 25 bp, mus musculus
cttatggtgtccccgctggaccact

SEQ ID NO: 106774 - DNA, 25 bp, mus musculus
ccaactggggatcagtggtgacata

SEQ ID NO: 106775 - DNA, 25 bp, mus musculus
ccagcgctaaccacgccatgatcta

SEQ ID NO: 106776 - DNA, 25 bp, mus musculus
cagcgctaaccacgccatgatctaa

SEQ ID NO: 106777 - DNA, 25 bp, mus musculus
gcgctaaccacgccatgatctaagc

SEQ ID NO: 106778 - DNA, 25 bp, mus musculus
cgctaaccacgccatgatctaagcc

SEQ ID NO: 106779 - DNA, 25 bp, mus musculus
gctaaccacgccatgatctaagcca

SEQ ID NO: 106780 - DNA, 25 bp, mus musculus
aatccctcttctgcttgctaaatct

SEQ ID NO: 106781 - DNA, 25 bp, mus musculus
ccctcttctgcttgctaaatctcac

SEQ ID NO: 106782 - DNA, 25 bp, mus musculus
atctcccatctctctggatttcttt

SEQ ID NO: 106783 - DNA, 25 bp, mus musculus
gcccaccaattcatttccagacttt

SEQ ID NO: 106784 - DNA, 25 bp, mus musculus
caattcatttccagactttgtactt

SEQ ID NO: 106785 - DNA, 25 bp, mus musculus
ttcatttccagactttgtacttcag

SEQ ID NO: 106786 - DNA, 25 bp, mus musculus
agactttgtacttcagaagcgatgg

SEQ ID NO: 106787 - DNA, 25 bp, mus musculus
tgtacttcagaagcgatggggaaaa

SEQ ID NO: 106788 - DNA, 25 bp, mus musculus
atcagcagcctttcaacttcaatta

SEQ ID NO: 106789 - DNA, 25 bp, mus musculus
gatctgcctctggtgacttcttgaa

SEQ ID NO: 106790 - DNA, 25 bp, mus musculus
ctgcctctggtgacttcttgaagat

SEQ ID NO: 106791 - DNA, 25 bp, mus musculus
cctctggtgacttcttgaagatata

SEQ ID NO: 106792 - DNA, 25 bp, mus musculus
tcttctgcttgctaaatctcactgt

SEQ ID NO: 106793 - DNA, 25 bp, mus musculus
tgctaaatctcactgtcactgctaa

SEQ ID NO: 106794 - DNA, 25 bp, mus musculus
taaatctcactgtcactgctaaatt

SEQ ID NO: 106795 - DNA, 25 bp, mus musculus
tcactgtcactgctaaattcagagc

SEQ ID NO: 106796 - DNA, 25 bp, mus musculus
cagatagagcctgcgcaatggaata

SEQ ID NO: 106797 - DNA, 25 bp, mus musculus
atagagcctgcgcaatggaataaag

SEQ ID NO: 106798 - DNA, 25 bp, mus musculus
atgtgacattgctctaacatctccc

SEQ ID NO: 106799 - DNA, 25 bp, mus musculus
tgctctaacatctcccatctctctg

SEQ ID NO: 106800 - DNA, 25 bp, mus musculus
atttcacaaaccacaatggcacagg

SEQ ID NO: 106801 - DNA, 25 bp, mus musculus
caaaccacaatggcacagggggcaa

SEQ ID NO: 106802 - DNA, 25 bp, mus musculus
ctcccagttcttcctgacctgtgat

SEQ ID NO: 106803 - DNA, 25 bp, mus musculus
cccagttcttcctgacctgtgataa

SEQ ID NO: 106804 - DNA, 25 bp, mus musculus
cagttcttcctgacctgtgataaga

SEQ ID NO: 106805 - DNA, 25 bp, mus musculus
gttcttcctgacctgtgataagaca

SEQ ID NO: 106806 - DNA, 25 bp, mus musculus
tcttcctgacctgtgataagacaga

SEQ ID NO: 106807 - DNA, 25 bp, mus musculus
ttcctgacctgtgataagacagatt

SEQ ID NO: 106808 - DNA, 25 bp, mus musculus
agacagattggctggacggcaagca

SEQ ID NO: 106809 - DNA, 25 bp, mus musculus
ggtcacggaaggcctggatgtcttg

SEQ ID NO: 106810 - DNA, 25 bp, mus musculus
tcacggaaggcctggatgtcttgcg

SEQ ID NO: 106811 - DNA, 25 bp, mus musculus
tcttgcggcagatcgaggctcaggg

SEQ ID NO: 106812 - DNA, 25 bp, mus musculus
aaccacaatggcacagggggcaagt

SEQ ID NO: 106813 - DNA, 25 bp, mus musculus
ggcaagtccatctatgggaagaagt

SEQ ID NO: 106814 - DNA, 25 bp, mus musculus
caagtccatctatgggaagaagttt

SEQ ID NO: 106815 - DNA, 25 bp, mus musculus
cttcatccttaaacacacaggacca

SEQ ID NO: 106816 - DNA, 25 bp, mus musculus
tcatccttaaacacacaggaccagg

SEQ ID NO: 106817 - DNA, 25 bp, mus musculus
ttaaacacacaggaccaggcctcct

SEQ ID NO: 106818 - DNA, 25 bp, mus musculus
acaggaccaggcctcctctccatgg

SEQ ID NO: 106819 - DNA, 25 bp, mus musculus
tctccatggccaattctggcccgaa

SEQ ID NO: 106820 - DNA, 25 bp, mus musculus
aaatgtcaccatccaatgtgactct

SEQ ID NO: 106821 - DNA, 25 bp, mus musculus
tggctttgccatgctgggttcccaa

SEQ ID NO: 106822 - DNA, 25 bp, mus musculus
ctacaagctgactctggaggttgaa

SEQ ID NO: 106823 - DNA, 25 bp, mus musculus
ggttgaactactacagctccagata

SEQ ID NO: 106824 - DNA, 25 bp, mus musculus
tgaagcacactgaccgggagttatg

SEQ ID NO: 106825 - DNA, 25 bp, mus musculus
ttctgacttcagttccaaacagatt

SEQ ID NO: 106826 - DNA, 25 bp, mus musculus
cttcagttccaaacagattgcctgc

SEQ ID NO: 106827 - DNA, 25 bp, mus musculus
ttccaaacagattgcctgcagttac

SEQ ID NO: 106828 - DNA, 25 bp, mus musculus
tttgtaatgctggcaccaatgttca

SEQ ID NO: 106829 - DNA, 25 bp, mus musculus
atctatgaaactatcatcttgtggc

SEQ ID NO: 106830 - DNA, 25 bp, mus musculus
aatttgcttttctgaatgcaatgtg

SEQ ID NO: 106831 - DNA, 25 bp, mus musculus
cttttctgaatgcaatgtgtacatt

SEQ ID NO: 106832 - DNA, 25 bp, mus musculus
gctgggttcccaaagcatcagttgt

SEQ ID NO: 106833 - DNA, 25 bp, mus musculus
gtatccagaggtgcccagatgtgag

SEQ ID NO: 106834 - DNA, 25 bp, mus musculus
ggcctctgaagaccttaagcctgcg

SEQ ID NO: 106835 - DNA, 25 bp, mus musculus
ccttaagcctgcgcttacaggcaac

SEQ ID NO: 106836 - DNA, 25 bp, mus musculus
gcctgcgcttacaggcaacaagacc

SEQ ID NO: 106837 - DNA, 25 bp, mus musculus
aggcaacaagaccatgcagtatgtg

SEQ ID NO: 106838 - DNA, 25 bp, mus musculus
caagaccatgcagtatgtgccaaat

SEQ ID NO: 106839 - DNA, 25 bp, mus musculus
gtatgtgccaaattcacacgatgtg

SEQ ID NO: 106840 - DNA, 25 bp, mus musculus
tgcgctaggctcccgtccaagtttc

SEQ ID NO: 106841 - DNA, 25 bp, mus musculus
gctaggctcccgtccaagtttctca

SEQ ID NO: 106842 - DNA, 25 bp, mus musculus
aatgccgtacaaggatgaggccaga

SEQ ID NO: 106843 - DNA, 25 bp, mus musculus
ggaaaagctgccttggctggcaagg

SEQ ID NO: 106844 - DNA, 25 bp, mus musculus
gaatttgataccttgctctagcctc

SEQ ID NO: 106845 - DNA, 25 bp, mus musculus
tttgataccttgctctagcctcaca

SEQ ID NO: 106846 - DNA, 25 bp, mus musculus
gataccttgctctagcctcacaggg

SEQ ID NO: 106847 - DNA, 25 bp, mus musculus
accttgctctagcctcacagggtcg

SEQ ID NO: 106848 - DNA, 25 bp, mus musculus
ctctagcctcacagggtcgatgagc

SEQ ID NO: 106849 - DNA, 25 bp, mus musculus
tagcctcacagggtcgatgagctgt

SEQ ID NO: 106850 - DNA, 25 bp, mus musculus
ggccatcttccctgtgtacatcagg

SEQ ID NO: 106851 - DNA, 25 bp, mus musculus
ccctgtgtacatcaggtggagcaga

SEQ ID NO: 106852 - DNA, 25 bp, mus musculus
tttctcaggccctaaattcatcttg

SEQ ID NO: 106853 - DNA, 25 bp, mus musculus
ctcaggccctaaattcatcttggtg

SEQ ID NO: 106854 - DNA, 25 bp, mus musculus
ccctaaattcatcttggtggcttgt

SEQ ID NO: 106855 - DNA, 25 bp, mus musculus
ggcttgtctcagctgatggtctgca

SEQ ID NO: 106856 - DNA, 25 bp, mus musculus
ttgtctcagctgatggtctgcaatc

SEQ ID NO: 106857 - DNA, 25 bp, mus musculus
tctcagctgatggtctgcaatctga

SEQ ID NO: 106858 - DNA, 25 bp, mus musculus
gtctgcaatctgaatgccgtacaag

SEQ ID NO: 106859 - DNA, 25 bp, mus musculus
ctgaatgccgtacaaggatgaggcc

SEQ ID NO: 106860 - DNA, 25 bp, mus musculus
aggtgctcggcctggtgaaggactt

SEQ ID NO: 106861 - DNA, 25 bp, mus musculus
cgcagccctcgacgggacaggtgaa

SEQ ID NO: 106862 - DNA, 25 bp, mus musculus
atgtggctgcgcagcgtggatcttc

SEQ ID NO: 106863 - DNA, 25 bp, mus musculus
ctgcgcagcgtggatcttcgagcct

SEQ ID NO: 106864 - DNA, 25 bp, mus musculus
agcgtggatcttcgagcctgcaggc

SEQ ID NO: 106865 - DNA, 25 bp, mus musculus
cgagcctgcaggcattgctcgtact

SEQ ID NO: 106866 - DNA, 25 bp, mus musculus
gcctgcaggcattgctcgtactgct

SEQ ID NO: 106867 - DNA, 25 bp, mus musculus
tgcaggcattgctcgtactgcttgc

SEQ ID NO: 106868 - DNA, 25 bp, mus musculus
cattgctcgtactgcttgctgcatg

SEQ ID NO: 106869 - DNA, 25 bp, mus musculus
tgctcgtactgcttgctgcatgcca

SEQ ID NO: 106870 - DNA, 25 bp, mus musculus
tcgtactgcttgctgcatgccaggg

SEQ ID NO: 106871 - DNA, 25 bp, mus musculus
ttgctgcatgccagggaaggagcag

SEQ ID NO: 106872 - DNA, 25 bp, mus musculus
cctcgtgcttccgcttgtgccttaa

SEQ ID NO: 106873 - DNA, 25 bp, mus musculus
tccgcttgtgccttaagagcttgga

SEQ ID NO: 106874 - DNA, 25 bp, mus musculus
gcttgtgccttaagagcttggacat

SEQ ID NO: 106875 - DNA, 25 bp, mus musculus
gcttggacatgctggtgaagttcca

SEQ ID NO: 106876 - DNA, 25 bp, mus musculus
tggtgaagttccagccgcagccgtc

SEQ ID NO: 106877 - DNA, 25 bp, mus musculus
tccagccgcagccgtcgaagtcaca

SEQ ID NO: 106878 - DNA, 25 bp, mus musculus
agccgtcgaagtcacacaggaaggg

SEQ ID NO: 106879 - DNA, 25 bp, mus musculus
cgtcgaagtcacacaggaagggtct

SEQ ID NO: 106880 - DNA, 25 bp, mus musculus
ctacgtctcattctccgcaacgcag

SEQ ID NO: 106881 - DNA, 25 bp, mus musculus
gcaacgcagttctccggcccgcaag

SEQ ID NO: 106882 - DNA, 25 bp, mus musculus
cctgctcttcgtcttcaatttcgtc

SEQ ID NO: 106883 - DNA, 25 bp, mus musculus
gtcttcaatttcgtcttctggctgg

SEQ ID NO: 106884 - DNA, 25 bp, mus musculus
tcaatttcgtcttctggctggctgg

SEQ ID NO: 106885 - DNA, 25 bp, mus musculus
aatttcgtcttctggctggctggag

SEQ ID NO: 106886 - DNA, 25 bp, mus musculus
tttcgtcttctggctggctggaggc

SEQ ID NO: 106887 - DNA, 25 bp, mus musculus
tcgtcttctggctggctggaggcgt

SEQ ID NO: 106888 - DNA, 25 bp, mus musculus
cttctggctggctggaggcgtgatc

SEQ ID NO: 106889 - DNA, 25 bp, mus musculus
tgatcctaggtgtagctctgtggtt

SEQ ID NO: 106890 - DNA, 25 bp, mus musculus
atcctaggtgtagctctgtggttgc

SEQ ID NO: 106891 - DNA, 25 bp, mus musculus
cctaggtgtagctctgtggttgcgt

SEQ ID NO: 106892 - DNA, 25 bp, mus musculus
aacgcagttctccggcccgcaagcg

SEQ ID NO: 106893 - DNA, 25 bp, mus musculus
tccaggctatctgccagtcccggac

SEQ ID NO: 106894 - DNA, 25 bp, mus musculus
ccaggaccaatccaagctccgcagg

SEQ ID NO: 106895 - DNA, 25 bp, mus musculus
aggaccaatccaagctccgcaggcc

SEQ ID NO: 106896 - DNA, 25 bp, mus musculus
gggctgcaccaaatgcatcaaatac

SEQ ID NO: 106897 - DNA, 25 bp, mus musculus
gctgcaccaaatgcatcaaatacct

SEQ ID NO: 106898 - DNA, 25 bp, mus musculus
aatacctgctcttcgtcttcaattt

SEQ ID NO: 106899 - DNA, 25 bp, mus musculus
tacctgctcttcgtcttcaatttcg

SEQ ID NO: 106900 - DNA, 25 bp, mus musculus
gccaccaggatgcggacattgaaga

SEQ ID NO: 106901 - DNA, 25 bp, mus musculus
ttcagccaattatcagcaaactcta

SEQ ID NO: 106902 - DNA, 25 bp, mus musculus
tagcccaagtggctgtttactgctt

SEQ ID NO: 106903 - DNA, 25 bp, mus musculus
ctgtttactgcttttcattagcagt

SEQ ID NO: 106904 - DNA, 25 bp, mus musculus
tttactgcttttcattagcagttgc

SEQ ID NO: 106905 - DNA, 25 bp, mus musculus
actgcttttcattagcagttgctca

SEQ ID NO: 106906 - DNA, 25 bp, mus musculus
ctcacatgtcttggggtcagggaga

SEQ ID NO: 106907 - DNA, 25 bp, mus musculus
gtgtgtgttcaccttggatatggtc

SEQ ID NO: 106908 - DNA, 25 bp, mus musculus
tgtgttcaccttggatatggtctat

SEQ ID NO: 106909 - DNA, 25 bp, mus musculus
gttcaccttggatatggtctattta

SEQ ID NO: 106910 - DNA, 25 bp, mus musculus
gtcatgcacatgtggtgtaggaact

SEQ ID NO: 106911 - DNA, 25 bp, mus musculus
tttctaccataagtgacaccaataa

SEQ ID NO: 106912 - DNA, 25 bp, mus musculus
agccaattatcagcaaactctatgg

SEQ ID NO: 106913 - DNA, 25 bp, mus musculus
caattatcagcaaactctatggaag

SEQ ID NO: 106914 - DNA, 25 bp, mus musculus
tcagcaaactctatggaagtggagg

SEQ ID NO: 106915 - DNA, 25 bp, mus musculus
aggtgcactgatctgctagagctgt

SEQ ID NO: 106916 - DNA, 25 bp, mus musculus
tggaatcttcacctcagagtggagt

SEQ ID NO: 106917 - DNA, 25 bp, mus musculus
aatcttcacctcagagtggagttga

SEQ ID NO: 106918 - DNA, 25 bp, mus musculus
cttcacctcagagtggagttgaaaa

SEQ ID NO: 106919 - DNA, 25 bp, mus musculus
atgctatagcccaagtggctgttta

SEQ ID NO: 106920 - DNA, 25 bp, mus musculus
tgggtctatatcctctttcgccggt

SEQ ID NO: 106921 - DNA, 25 bp, mus musculus
ccagcccaggccatgctcagtggac

SEQ ID NO: 106922 - DNA, 25 bp, mus musculus
cccttgccagcatctgagtctgaga

SEQ ID NO: 106923 - DNA, 25 bp, mus musculus
ccagcatctgagtctgagacacagg

SEQ ID NO: 106924 - DNA, 25 bp, mus musculus
acacagggcttcacattcctccagg

SEQ ID NO: 106925 - DNA, 25 bp, mus musculus
acattcctccaggctcacaggtcac

SEQ ID NO: 106926 - DNA, 25 bp, mus musculus
caccaacctctccagtgtttcctga

SEQ ID NO: 106927 - DNA, 25 bp, mus musculus
cagtgtttcctgagcccccttgctc

SEQ ID NO: 106928 - DNA, 25 bp, mus musculus
cttgctccatggctgcctaacacac

SEQ ID NO: 106929 - DNA, 25 bp, mus musculus
ccatggctgcctaacacacatgctc

SEQ ID NO: 106930 - DNA, 25 bp, mus musculus
ctgcctaacacacatgctcaataaa

SEQ ID NO: 106931 - DNA, 25 bp, mus musculus
aacacacatgctcaataaatggttg

SEQ ID NO: 106932 - DNA, 25 bp, mus musculus
atgctcagtggaccctgaaggacag

SEQ ID NO: 106933 - DNA, 25 bp, mus musculus
gtccttggtgactgccattgacctg

SEQ ID NO: 106934 - DNA, 25 bp, mus musculus
ggtgactgccattgacctgtgccct

SEQ ID NO: 106935 - DNA, 25 bp, mus musculus
actgcaaagatacctcctctatgct

SEQ ID NO: 106936 - DNA, 25 bp, mus musculus
aagatacctcctctatgctagagag

SEQ ID NO: 106937 - DNA, 25 bp, mus musculus
cctcctctatgctagagaggtcctc

SEQ ID NO: 106938 - DNA, 25 bp, mus musculus
actactccctgtcagccaggaggct

SEQ ID NO: 106939 - DNA, 25 bp, mus musculus
gccccctggcaggaatctaggattc

SEQ ID NO: 106940 - DNA, 25 bp, mus musculus
ggcttacgtctctacaggcctcatc

SEQ ID NO: 106941 - DNA, 25 bp, mus musculus
tacaggcctcatctggcatcagaga

SEQ ID NO: 106942 - DNA, 25 bp, mus musculus
agagccctggacatctaggaatgcc

SEQ ID NO: 106943 - DNA, 25 bp, mus musculus
atctaggaatgcctttcttctctcg

SEQ ID NO: 106944 - DNA, 25 bp, mus musculus
ctttcttctctcgttccctgcgata

SEQ ID NO: 106945 - DNA, 25 bp, mus musculus
tgcgatactgctctaagcaaaggtc

SEQ ID NO: 106946 - DNA, 25 bp, mus musculus
atttctgtgcctagtattacccata

SEQ ID NO: 106947 - DNA, 25 bp, mus musculus
aacttcaagactcctaacagactga

SEQ ID NO: 106948 - DNA, 25 bp, mus musculus
aagactcctaacagactgaattggg

SEQ ID NO: 106949 - DNA, 25 bp, mus musculus
gtaaatagctccactagttgtccaa

SEQ ID NO: 106950 - DNA, 25 bp, mus musculus
agctccactagttgtccaacagctt

SEQ ID NO: 106951 - DNA, 25 bp, mus musculus
tgtccaacagcttgttggttaagtg

SEQ ID NO: 106952 - DNA, 25 bp, mus musculus
tataccatcatgtacagctgctggc

SEQ ID NO: 106953 - DNA, 25 bp, mus musculus
atcatgtacagctgctggcacgaga

SEQ ID NO: 106954 - DNA, 25 bp, mus musculus
tacagctgctggcacgagaaagcag

SEQ ID NO: 106955 - DNA, 25 bp, mus musculus
gctggctgctaagctccgtggatct

SEQ ID NO: 106956 - DNA, 25 bp, mus musculus
tgctaagctccgtggatctcctcct

SEQ ID NO: 106957 - DNA, 25 bp, mus musculus
tctctcctacaaaacctaattccat

SEQ ID NO: 106958 - DNA, 25 bp, mus musculus
agttccctggctgcagctctagctt

SEQ ID NO: 106959 - DNA, 25 bp, mus musculus
tccatgcgcctactgaatgcatgaa

SEQ ID NO: 106960 - DNA, 25 bp, mus musculus
agacctacgattacctgttcaagct

SEQ ID NO: 106961 - DNA, 25 bp, mus musculus
acgattacctgttcaagctgctgct

SEQ ID NO: 106962 - DNA, 25 bp, mus musculus
cattcatctctaccataggaattga

SEQ ID NO: 106963 - DNA, 25 bp, mus musculus
tcatctctaccataggaattgactt

SEQ ID NO: 106964 - DNA, 25 bp, mus musculus
tagagctcgatggcaagaggattaa

SEQ ID NO: 106965 - DNA, 25 bp, mus musculus
caatcacgacagcctactacagggg

SEQ ID NO: 106966 - DNA, 25 bp, mus musculus
tcacgacagcctactacaggggtgc

SEQ ID NO: 106967 - DNA, 25 bp, mus musculus
cgacagcctactacaggggtgccat

SEQ ID NO: 106968 - DNA, 25 bp, mus musculus
cctactacaggggtgccatgggtat

SEQ ID NO: 106969 - DNA, 25 bp, mus musculus
actacaggggtgccatgggtatcat

SEQ ID NO: 106970 - DNA, 25 bp, mus musculus
tctacgacattaccaatgagaagtc

SEQ ID NO: 106971 - DNA, 25 bp, mus musculus
acgacattaccaatgagaagtcctt

SEQ ID NO: 106972 - DNA, 25 bp, mus musculus
attacctgttcaagctgctgctgat

SEQ ID NO: 106973 - DNA, 25 bp, mus musculus
agtcctttgacaacatccggaattg

SEQ ID NO: 106974 - DNA, 25 bp, mus musculus
tgttcaagctgctgctgatcgggga

SEQ ID NO: 106975 - DNA, 25 bp, mus musculus
agacctgtgtcctgttccgcttctc

SEQ ID NO: 106976 - DNA, 25 bp, mus musculus
cctgtgtcctgttccgcttctccga

SEQ ID NO: 106977 - DNA, 25 bp, mus musculus
tgttccgcttctccgaggacgcctt

SEQ ID NO: 106978 - DNA, 25 bp, mus musculus
aggacgccttcaactccacattcat

SEQ ID NO: 106979 - DNA, 25 bp, mus musculus
tcaactccacattcatctctaccat

SEQ ID NO: 106980 - DNA, 25 bp, mus musculus
ccacattcatctctaccataggaat

SEQ ID NO: 106981 - DNA, 25 bp, mus musculus
tgccctgacagaagcagccaaggga

SEQ ID NO: 106982 - DNA, 25 bp, mus musculus
ggtttatcctgactcacagttccat

SEQ ID NO: 106983 - DNA, 25 bp, mus musculus
gcatgctcagttcctttttgtctca

SEQ ID NO: 106984 - DNA, 25 bp, mus musculus
tgtctcattaacctgagcccaggag

SEQ ID NO: 106985 - DNA, 25 bp, mus musculus
ctgagcccaggagctggagttggcc

SEQ ID NO: 106986 - DNA, 25 bp, mus musculus
tctccagacatcatgcctagaggcc

SEQ ID NO: 106987 - DNA, 25 bp, mus musculus
gacatcatgcctagaggcctatctt

SEQ ID NO: 106988 - DNA, 25 bp, mus musculus
gaactaataaccatcatagtaagtt

SEQ ID NO: 106989 - DNA, 25 bp, mus musculus
tttctcccaggaagaaggcttgaca

SEQ ID NO: 106990 - DNA, 25 bp, mus musculus
ataattagatctgctgccaggtttt

SEQ ID NO: 106991 - DNA, 25 bp, mus musculus
agatctgctgccaggttttgccctt

SEQ ID NO: 106992 - DNA, 25 bp, mus musculus
ttaatatgctccatagtaaggcttc

SEQ ID NO: 106993 - DNA, 25 bp, mus musculus
ctcacagttccatgttccagtccgt

SEQ ID NO: 106994 - DNA, 25 bp, mus musculus
ctttggccaatttccacaatcactg

SEQ ID NO: 106995 - DNA, 25 bp, mus musculus
tgttccagtccgttgtcgcattgtc

SEQ ID NO: 106996 - DNA, 25 bp, mus musculus
agtccgttgtcgcattgtcacagtg

SEQ ID NO: 106997 - DNA, 25 bp, mus musculus
cattgtcacagtggcaggaactcca

SEQ ID NO: 106998 - DNA, 25 bp, mus musculus
ggcaggaactccagacatctgccac

SEQ ID NO: 106999 - DNA, 25 bp, mus musculus
aactccagacatctgccacatggct

SEQ ID NO: 107000 - DNA, 25 bp, mus musculus
ctgccacatggctccatagccagga

SEQ ID NO: 107001 - DNA, 25 bp, mus musculus
tccatagccaggaagctgagagctg

SEQ ID NO: 107002 - DNA, 25 bp, mus musculus
cagccaatctcaagtccatcccttt

SEQ ID NO: 107003 - DNA, 25 bp, mus musculus
atctcaagtccatccctttaagcca

SEQ ID NO: 107004 - DNA, 25 bp, mus musculus
tcaaccggcagaggagccacacaga

SEQ ID NO: 107005 - DNA, 25 bp, mus musculus
ggagccacacagatctcttggccat

SEQ ID NO: 107006 - DNA, 25 bp, mus musculus
cagatctcttggccatctgcagctt

SEQ ID NO: 107007 - DNA, 25 bp, mus musculus
tcttggccatctgcagcttccaggg

SEQ ID NO: 107008 - DNA, 25 bp, mus musculus
ccatctgcagcttccagggagttcc

SEQ ID NO: 107009 - DNA, 25 bp, mus musculus
gcttccaactactagatccggtctt

SEQ ID NO: 107010 - DNA, 25 bp, mus musculus
tagatccggtcttccgtctccgatc

SEQ ID NO: 107011 - DNA, 25 bp, mus musculus
tccgtctccgatctggaaaacgcca

SEQ ID NO: 107012 - DNA, 25 bp, mus musculus
tcctctgcaccctggtcgatggagt

SEQ ID NO: 107013 - DNA, 25 bp, mus musculus
tctgcaccctggtcgatggagtgct

SEQ ID NO: 107014 - DNA, 25 bp, mus musculus
agtccatccctttaagccaatcaca

SEQ ID NO: 107015 - DNA, 25 bp, mus musculus
gccaatcacaaaccaccttgatgcc

SEQ ID NO: 107016 - DNA, 25 bp, mus musculus
aatcacaaaccaccttgatgccagc

SEQ ID NO: 107017 - DNA, 25 bp, mus musculus
aaaccaccttgatgccagccctgct

SEQ ID NO: 107018 - DNA, 25 bp, mus musculus
ccttgatgccagccctgctgagtgg

SEQ ID NO: 107019 - DNA, 25 bp, mus musculus
gtggtttgctaccactcaaccggca

SEQ ID NO: 107020 - DNA, 25 bp, mus musculus
gtttgctaccactcaaccggcagag

SEQ ID NO: 107021 - DNA, 25 bp, mus musculus
tgctaccactcaaccggcagaggag

SEQ ID NO: 107022 - DNA, 25 bp, mus musculus
ccaagcctgcctggacagctgttct

SEQ ID NO: 107023 - DNA, 25 bp, mus musculus
ctgcctggacagctgttctgtgact

SEQ ID NO: 107024 - DNA, 25 bp, mus musculus
ggctgacacagcctcgcctgtagtg

SEQ ID NO: 107025 - DNA, 25 bp, mus musculus
caccatgctgtccttgtggagtctt

SEQ ID NO: 107026 - DNA, 25 bp, mus musculus
tgtggtccaaccaagggaacgctgt

SEQ ID NO: 107027 - DNA, 25 bp, mus musculus
ccaaccaagggaacgctgtcatcct

SEQ ID NO: 107028 - DNA, 25 bp, mus musculus
ccctgcagcaaggggatgctgcagc

SEQ ID NO: 107029 - DNA, 25 bp, mus musculus
cagcagctgtgcagttctctggtag

SEQ ID NO: 107030 - DNA, 25 bp, mus musculus
ctgtgcagttctctggtagccacca

SEQ ID NO: 107031 - DNA, 25 bp, mus musculus
agttctctggtagccaccagtcttg

SEQ ID NO: 107032 - DNA, 25 bp, mus musculus
agtcttgctgtctcttggctgagaa

SEQ ID NO: 107033 - DNA, 25 bp, mus musculus
gctgtctcttggctgagaataaaac

SEQ ID NO: 107034 - DNA, 25 bp, mus musculus
aagcgtcctattcatcatctgtgac

SEQ ID NO: 107035 - DNA, 25 bp, mus musculus
cctattcatcatctgtgacttagtc

SEQ ID NO: 107036 - DNA, 25 bp, mus musculus
catcatctgtgacttagtctgttgt

SEQ ID NO: 107037 - DNA, 25 bp, mus musculus
ctgtgacttagtctgttgtagtggt

SEQ ID NO: 107038 - DNA, 25 bp, mus musculus
tgagctgacacatccagatgtgatg

SEQ ID NO: 107039 - DNA, 25 bp, mus musculus
ttgtgcccctctgtggtattgctcc

SEQ ID NO: 107040 - DNA, 25 bp, mus musculus
ttgctcctgcgacattctataaata

SEQ ID NO: 107041 - DNA, 25 bp, mus musculus
atatatggctgacacagcctcgcct

SEQ ID NO: 107042 - DNA, 25 bp, mus musculus
tatttcttcatgaagacctcacggt

SEQ ID NO: 107043 - DNA, 25 bp, mus musculus
ttcatgaagacctcacggtaaaaat

SEQ ID NO: 107044 - DNA, 25 bp, mus musculus
gatacctatctccagatctcagtaa

SEQ ID NO: 107045 - DNA, 25 bp, mus musculus
actgtccaaaagccatgaagagatt

SEQ ID NO: 107046 - DNA, 25 bp, mus musculus
ttgagctgctggcccgctcattgcc

SEQ ID NO: 107047 - DNA, 25 bp, mus musculus
cccgctcattgccaaaaattcaccg

SEQ ID NO: 107048 - DNA, 25 bp, mus musculus
ttcaccgcagtgcatcagaaccttc

SEQ ID NO: 107049 - DNA, 25 bp, mus musculus
catcagaaccttccttgaatcgggc

SEQ ID NO: 107050 - DNA, 25 bp, mus musculus
gtctgtatgcttgtgcttctccgaa

SEQ ID NO: 107051 - DNA, 25 bp, mus musculus
atgcttgtgcttctccgaaaacacc

SEQ ID NO: 107052 - DNA, 25 bp, mus musculus
gtgcttctccgaaaacacccatcca

SEQ ID NO: 107053 - DNA, 25 bp, mus musculus
acaccctgagtgagacattaaagta

SEQ ID NO: 107054 - DNA, 25 bp, mus musculus
actttggtctagccacagtgaaatc

SEQ ID NO: 107055 - DNA, 25 bp, mus musculus
gtctagccacagtgaaatctcggtg

SEQ ID NO: 107056 - DNA, 25 bp, mus musculus
ggtcccatcagtttgaacagttgtc

SEQ ID NO: 107057 - DNA, 25 bp, mus musculus
ttgttctgtacgaactgatgaccgg

SEQ ID NO: 107058 - DNA, 25 bp, mus musculus
aactgatgaccggccagctacctta

SEQ ID NO: 107059 - DNA, 25 bp, mus musculus
taccttattcaaacatcaacaacag

SEQ ID NO: 107060 - DNA, 25 bp, mus musculus
attcaaacatcaacaacagggatca

SEQ ID NO: 107061 - DNA, 25 bp, mus musculus
acatcaacaacagggatcagataat

SEQ ID NO: 107062 - DNA, 25 bp, mus musculus
gtattcaggagtctccagtgccgaa

SEQ ID NO: 107063 - DNA, 25 bp, mus musculus
ctccagtgccgaatggccactcact

SEQ ID NO: 107064 - DNA, 25 bp, mus musculus
acatgaaagccaacttgacgagccc

SEQ ID NO: 107065 - DNA, 25 bp, mus musculus
acatcgggagcagcgttccaggccc

SEQ ID NO: 107066 - DNA, 25 bp, mus musculus
cacagtcctaccctattgtcacagg

SEQ ID NO: 107067 - DNA, 25 bp, mus musculus
cctaccctattgtcacaggccgaga

SEQ ID NO: 107068 - DNA, 25 bp, mus musculus
ctattgtcacaggccgagacttggc

SEQ ID NO: 107069 - DNA, 25 bp, mus musculus
tcacaggccgagacttggcgagcac

SEQ ID NO: 107070 - DNA, 25 bp, mus musculus
accctcagtattcttcctacaatga

SEQ ID NO: 107071 - DNA, 25 bp, mus musculus
agtattcttcctacaatgattcttg

SEQ ID NO: 107072 - DNA, 25 bp, mus musculus
cttcctacaatgattcttggaggtt

SEQ ID NO: 107073 - DNA, 25 bp, mus musculus
ttggctccccatactattacagccc

SEQ ID NO: 107074 - DNA, 25 bp, mus musculus
gagacctgttcacacagcagcagct

SEQ ID NO: 107075 - DNA, 25 bp, mus musculus
tgttcacacagcagcagctggaggt

SEQ ID NO: 107076 - DNA, 25 bp, mus musculus
tgctggaccgcgtgtttgagagaca

SEQ ID NO: 107077 - DNA, 25 bp, mus musculus
actctgacatcttcaccaccacgga

SEQ ID NO: 107078 - DNA, 25 bp, mus musculus
ccacggaacccatcaagccagaaca

SEQ ID NO: 107079 - DNA, 25 bp, mus musculus
tcaagccagaacagaccacagagta

SEQ ID NO: 107080 - DNA, 25 bp, mus musculus
ccatggcttcactggctggaggcct

SEQ ID NO: 107081 - DNA, 25 bp, mus musculus
cttcactggctggaggcctggatga

SEQ ID NO: 107082 - DNA, 25 bp, mus musculus
gaatttgcactattacacttgaaag

SEQ ID NO: 107083 - DNA, 25 bp, mus musculus
ctattacacttgaaagttctcagta

SEQ ID NO: 107084 - DNA, 25 bp, mus musculus
gttagcaccagccagctctctgtac

SEQ ID NO: 107085 - DNA, 25 bp, mus musculus
agcaccagccagctctctgtacatt

SEQ ID NO: 107086 - DNA, 25 bp, mus musculus
cagctctctgtacatttgctagctt

SEQ ID NO: 107087 - DNA, 25 bp, mus musculus
ctctctgtacatttgctagcttgta

SEQ ID NO: 107088 - DNA, 25 bp, mus musculus
tctgtacatttgctagcttgtagtt

SEQ ID NO: 107089 - DNA, 25 bp, mus musculus
catttgctagcttgtagttttctaa

SEQ ID NO: 107090 - DNA, 25 bp, mus musculus
tttctaagactgagtggagtaaact

SEQ ID NO: 107091 - DNA, 25 bp, mus musculus
tcccacaaaccaccatctattttgt

SEQ ID NO: 107092 - DNA, 25 bp, mus musculus
cacaaaccaccatctattttgtgaa

SEQ ID NO: 107093 - DNA, 25 bp, mus musculus
ccatctattttgtgaactttgttag

SEQ ID NO: 107094 - DNA, 25 bp, mus musculus
gttctcagtaacttttttggcagct

SEQ ID NO: 107095 - DNA, 25 bp, mus musculus
ttttttggcagctcaataggaaagc

SEQ ID NO: 107096 - DNA, 25 bp, mus musculus
agacaaacttagtacgcatgacctg

SEQ ID NO: 107097 - DNA, 25 bp, mus musculus
ttgtgtttttggcgttgagagtagg

SEQ ID NO: 107098 - DNA, 25 bp, mus musculus
ggagcgaccaggctctgcatggcag

SEQ ID NO: 107099 - DNA, 25 bp, mus musculus
cttcaaaaagacactgtctcaactg

SEQ ID NO: 107100 - DNA, 25 bp, mus musculus
gacactgtctcaactgtggttgtta

SEQ ID NO: 107101 - DNA, 25 bp, mus musculus
actgtctcaactgtggttgttagca

SEQ ID NO: 107102 - DNA, 25 bp, mus musculus
ctccgccgtgcgttgtggaccaaca

SEQ ID NO: 107103 - DNA, 25 bp, mus musculus
tccgccgtgcgttgtggaccaacat

SEQ ID NO: 107104 - DNA, 25 bp, mus musculus
tccgaaagctgtgctcagacaggaa

SEQ ID NO: 107105 - DNA, 25 bp, mus musculus
gaaagctgtgctcagacaggaatgt

SEQ ID NO: 107106 - DNA, 25 bp, mus musculus
aagctgtgctcagacaggaatgtgg

SEQ ID NO: 107107 - DNA, 25 bp, mus musculus
aatgtggtgcctttgccaaatgctc

SEQ ID NO: 107108 - DNA, 25 bp, mus musculus
atgtggtgcctttgccaaatgctca

SEQ ID NO: 107109 - DNA, 25 bp, mus musculus
tggtgcctttgccaaatgctcactt

SEQ ID NO: 107110 - DNA, 25 bp, mus musculus
gtgcctttgccaaatgctcacttta

SEQ ID NO: 107111 - DNA, 25 bp, mus musculus
tgcctttgccaaatgctcactttaa

SEQ ID NO: 107112 - DNA, 25 bp, mus musculus
ctttgccaaatgctcactttaaaat

SEQ ID NO: 107113 - DNA, 25 bp, mus musculus
ttgccaaatgctcactttaaaatcg

SEQ ID NO: 107114 - DNA, 25 bp, mus musculus
ttgtggaccaacatgggcctgaaaa

SEQ ID NO: 107115 - DNA, 25 bp, mus musculus
tgccaaatgctcactttaaaatcgt

SEQ ID NO: 107116 - DNA, 25 bp, mus musculus
tggaccaacatgggcctgaaaaagg

SEQ ID NO: 107117 - DNA, 25 bp, mus musculus
ccaacatgggcctgaaaaaggagct

SEQ ID NO: 107118 - DNA, 25 bp, mus musculus
gccttgaacttcttaagaaggctga

SEQ ID NO: 107119 - DNA, 25 bp, mus musculus
gcagtcaacggattccgaaagctgt

SEQ ID NO: 107120 - DNA, 25 bp, mus musculus
cagtcaacggattccgaaagctgtg

SEQ ID NO: 107121 - DNA, 25 bp, mus musculus
aacggattccgaaagctgtgctcag

SEQ ID NO: 107122 - DNA, 25 bp, mus musculus
gattccgaaagctgtgctcagacag

SEQ ID NO: 107123 - DNA, 25 bp, mus musculus
acggcggcatcacggacatgctcgt

SEQ ID NO: 107124 - DNA, 25 bp, mus musculus
gcggcatcacggacatgctcgtgga

SEQ ID NO: 107125 - DNA, 25 bp, mus musculus
tgatagccaagtacccacacaaaat

SEQ ID NO: 107126 - DNA, 25 bp, mus musculus
tagccaagtacccacacaaaatcaa

SEQ ID NO: 107127 - DNA, 25 bp, mus musculus
agtacccacacaaaatcaagagcgg

SEQ ID NO: 107128 - DNA, 25 bp, mus musculus
acccacacaaaatcaagagcggacg

SEQ ID NO: 107129 - DNA, 25 bp, mus musculus
atacaagttcatccatcaatttcct

SEQ ID NO: 107130 - DNA, 25 bp, mus musculus
caagttcatccatcaatttcctgac

SEQ ID NO: 107131 - DNA, 25 bp, mus musculus
gttcatccatcaatttcctgactcg

SEQ ID NO: 107132 - DNA, 25 bp, mus musculus
ccatcaatttcctgactcgagttac

SEQ ID NO: 107133 - DNA, 25 bp, mus musculus
tcaatttcctgactcgagttactgg

SEQ ID NO: 107134 - DNA, 25 bp, mus musculus
atttcctgactcgagttactggcat

SEQ ID NO: 107135 - DNA, 25 bp, mus musculus
gcatcacggacatgctcgtggaact

SEQ ID NO: 107136 - DNA, 25 bp, mus musculus
tgactcgagttactggcattggacc

SEQ ID NO: 107137 - DNA, 25 bp, mus musculus
cggacatgctcgtggaactcgcaaa

SEQ ID NO: 107138 - DNA, 25 bp, mus musculus
acatgctcgtggaactcgcaaactt

SEQ ID NO: 107139 - DNA, 25 bp, mus musculus
tggaactcgcaaactttgagaagaa

SEQ ID NO: 107140 - DNA, 25 bp, mus musculus
acgtgagccaggcgatccacaagta

SEQ ID NO: 107141 - DNA, 25 bp, mus musculus
tgagccaggcgatccacaagtacaa

SEQ ID NO: 107142 - DNA, 25 bp, mus musculus
gccaggcgatccacaagtacaatgc

SEQ ID NO: 107143 - DNA, 25 bp, mus musculus
cgatccacaagtacaatgcgtacag

SEQ ID NO: 107144 - DNA, 25 bp, mus musculus
gcgagcctcgttgggtttatgtctt

SEQ ID NO: 107145 - DNA, 25 bp, mus musculus
cgaaaacgagctgttgcgcaccatt

SEQ ID NO: 107146 - DNA, 25 bp, mus musculus
tgcgcaccatttggtacctgtattg

SEQ ID NO: 107147 - DNA, 25 bp, mus musculus
cgcaccatttggtacctgtattggg

SEQ ID NO: 107148 - DNA, 25 bp, mus musculus
gcaccatttggtacctgtattgggt

SEQ ID NO: 107149 - DNA, 25 bp, mus musculus
caccatttggtacctgtattgggtg

SEQ ID NO: 107150 - DNA, 25 bp, mus musculus
ttggtacctgtattgggtgaaacat

SEQ ID NO: 107151 - DNA, 25 bp, mus musculus
agaagcttacagcctcagtggcgaa

SEQ ID NO: 107152 - DNA, 25 bp, mus musculus
gaagcttacagcctcagtggcgaaa

SEQ ID NO: 107153 - DNA, 25 bp, mus musculus
agcttacagcctcagtggcgaaaat

SEQ ID NO: 107154 - DNA, 25 bp, mus musculus
gcttacagcctcagtggcgaaaatt

SEQ ID NO: 107155 - DNA, 25 bp, mus musculus
cttacagcctcagtggcgaaaattt

SEQ ID NO: 107156 - DNA, 25 bp, mus musculus
aacgagctgttgcgcaccatttggt

SEQ ID NO: 107157 - DNA, 25 bp, mus musculus
aattttttcatgtcagagaccgaga

SEQ ID NO: 107158 - DNA, 25 bp, mus musculus
acgagctgttgcgcaccatttggta

SEQ ID NO: 107159 - DNA, 25 bp, mus musculus
cgagctgttgcgcaccatttggtac

SEQ ID NO: 107160 - DNA, 25 bp, mus musculus
agctgttgcgcaccatttggtacct

SEQ ID NO: 107161 - DNA, 25 bp, mus musculus
gctgttgcgcaccatttggtacctg

SEQ ID NO: 107162 - DNA, 25 bp, mus musculus
ctgttgcgcaccatttggtacctgt

SEQ ID NO: 107163 - DNA, 25 bp, mus musculus
gttgcgcaccatttggtacctgtat

SEQ ID NO: 107164 - DNA, 25 bp, mus musculus
ttgcgcaccatttggtacctgtatt

SEQ ID NO: 107165 - DNA, 25 bp, mus musculus
ttcgaacatcgatcttccaaactac

SEQ ID NO: 107166 - DNA, 25 bp, mus musculus
tttggcttacctctgggaagaagag

SEQ ID NO: 107167 - DNA, 25 bp, mus musculus
tacctaacattgaacacagagaagt

SEQ ID NO: 107168 - DNA, 25 bp, mus musculus
aaacttcgtgctccccaatgtcagt

SEQ ID NO: 107169 - DNA, 25 bp, mus musculus
cttcgtgctccccaatgtcagttct

SEQ ID NO: 107170 - DNA, 25 bp, mus musculus
gctccccaatgtcagttctggagac

SEQ ID NO: 107171 - DNA, 25 bp, mus musculus
ccccaatgtcagttctggagactat

SEQ ID NO: 107172 - DNA, 25 bp, mus musculus
ggatttcatcgctggagcaattaca

SEQ ID NO: 107173 - DNA, 25 bp, mus musculus
caatttaacgattacactagcaaga

SEQ ID NO: 107174 - DNA, 25 bp, mus musculus
tttaacgattacactagcaagaaag

SEQ ID NO: 107175 - DNA, 25 bp, mus musculus
catttaccctttatagaatgttcat

SEQ ID NO: 107176 - DNA, 25 bp, mus musculus
tgttcattttactgtagatgaaggc

SEQ ID NO: 107177 - DNA, 25 bp, mus musculus
gaaatctttagtcgatccataatga

SEQ ID NO: 107178 - DNA, 25 bp, mus musculus
atctttagtcgatccataatgaaaa

SEQ ID NO: 107179 - DNA, 25 bp, mus musculus
tatggacatcccaatgggacccagg

SEQ ID NO: 107180 - DNA, 25 bp, mus musculus
cccaatgggacccagggcaatagca

SEQ ID NO: 107181 - DNA, 25 bp, mus musculus
aatgggacccagggcaatagcacaa

SEQ ID NO: 107182 - DNA, 25 bp, mus musculus
aatagcacaatgtggcctgtcttca

SEQ ID NO: 107183 - DNA, 25 bp, mus musculus
atgtggcctgtcttcacaagtactg

SEQ ID NO: 107184 - DNA, 25 bp, mus musculus
tggcctgtcttcacaagtactgaac

SEQ ID NO: 107185 - DNA, 25 bp, mus musculus
cttccaatggatccccatggagacc

SEQ ID NO: 107186 - DNA, 25 bp, mus musculus
tccaatggatccccatggagaccca

SEQ ID NO: 107187 - DNA, 25 bp, mus musculus
gacccgagagtggtcatgtgaaagg

SEQ ID NO: 107188 - DNA, 25 bp, mus musculus
aatgaaggaccttcgccagttgcga

SEQ ID NO: 107189 - DNA, 25 bp, mus musculus
tgaaggaccttcgccagttgcgaga

SEQ ID NO: 107190 - DNA, 25 bp, mus musculus
aaggaccttcgccagttgcgagatg

SEQ ID NO: 107191 - DNA, 25 bp, mus musculus
accttcgccagttgcgagatggcaa

SEQ ID NO: 107192 - DNA, 25 bp, mus musculus
tcgccagttgcgagatggcaaagta

SEQ ID NO: 107193 - DNA, 25 bp, mus musculus
gaagattctatcaacagttgtaggg

SEQ ID NO: 107194 - DNA, 25 bp, mus musculus
attctatcaacagttgtaggggtga

SEQ ID NO: 107195 - DNA, 25 bp, mus musculus
tctatcaacagttgtaggggtgacc

SEQ ID NO: 107196 - DNA, 25 bp, mus musculus
tatcaacagttgtaggggtgaccat

SEQ ID NO: 107197 - DNA, 25 bp, mus musculus
caatggatccccatggagacccata

SEQ ID NO: 107198 - DNA, 25 bp, mus musculus
atggatccccatggagacccatatg

SEQ ID NO: 107199 - DNA, 25 bp, mus musculus
atccccatggagacccatatggacc

SEQ ID NO: 107200 - DNA, 25 bp, mus musculus
ccccatggagacccatatggaccat

SEQ ID NO: 107201 - DNA, 25 bp, mus musculus
atatggaccatgtgcttaggttcac

SEQ ID NO: 107202 - DNA, 25 bp, mus musculus
accatgtgcttaggttcacaggttt

SEQ ID NO: 107203 - DNA, 25 bp, mus musculus
catgtgcttaggttcacaggttttg

SEQ ID NO: 107204 - DNA, 25 bp, mus musculus
aggacccgagagtggtcatgtgaaa

SEQ ID NO: 107205 - DNA, 25 bp, mus musculus
agtccactccatgtagccacaggac

SEQ ID NO: 107206 - DNA, 25 bp, mus musculus
ctccatgtagccacaggactgtctc

SEQ ID NO: 107207 - DNA, 25 bp, mus musculus
ctgcctgacttttatctgcggaacc

SEQ ID NO: 107208 - DNA, 25 bp, mus musculus
gacttttatctgcggaacctgacct

SEQ ID NO: 107209 - DNA, 25 bp, mus musculus
aagtaagaacctgcacaccaagtat

SEQ ID NO: 107210 - DNA, 25 bp, mus musculus
gcacaccaagtatctgggattcctg

SEQ ID NO: 107211 - DNA, 25 bp, mus musculus
caagtatctgggattcctggaatgc

SEQ ID NO: 107212 - DNA, 25 bp, mus musculus
attcctggaatgcctctccatgcaa

SEQ ID NO: 107213 - DNA, 25 bp, mus musculus
cctctccatgcaaatgaggcattcc

SEQ ID NO: 107214 - DNA, 25 bp, mus musculus
gcattcccagtactttaaacttcat

SEQ ID NO: 107215 - DNA, 25 bp, mus musculus
cttcctatactccaaggttcatgta

SEQ ID NO: 107216 - DNA, 25 bp, mus musculus
tcatgtatagccctggtttacccca

SEQ ID NO: 107217 - DNA, 25 bp, mus musculus
acaggactgtctctttcttcagatt

SEQ ID NO: 107218 - DNA, 25 bp, mus musculus
ctgtctctttcttcagattcataga

SEQ ID NO: 107219 - DNA, 25 bp, mus musculus
ctttcttcagattcatagaactacg

SEQ ID NO: 107220 - DNA, 25 bp, mus musculus
gaaattatctcactcactcaccttg

SEQ ID NO: 107221 - DNA, 25 bp, mus musculus
ctcactcaccttgagtacaggaggg

SEQ ID NO: 107222 - DNA, 25 bp, mus musculus
tattctaaaccaaaagacatcatgg

SEQ ID NO: 107223 - DNA, 25 bp, mus musculus
tattcctctgagcttggtgcaaaac

SEQ ID NO: 107224 - DNA, 25 bp, mus musculus
ttttccagcagggcgtcttcttctc

SEQ ID NO: 107225 - DNA, 25 bp, mus musculus
gcgctctcccagaattgaacacttt

SEQ ID NO: 107226 - DNA, 25 bp, mus musculus
aattgaacactttctgcctgggatg

SEQ ID NO: 107227 - DNA, 25 bp, mus musculus
ctttgagtgcctttttgaacgctgc

SEQ ID NO: 107228 - DNA, 25 bp, mus musculus
cctttttgaacgctgctccacaggg

SEQ ID NO: 107229 - DNA, 25 bp, mus musculus
ttttgaacgctgctccacagggcct

SEQ ID NO: 107230 - DNA, 25 bp, mus musculus
ctgctccacagggcctgggttttct

SEQ ID NO: 107231 - DNA, 25 bp, mus musculus
cacagggcctgggttttcttgagct

SEQ ID NO: 107232 - DNA, 25 bp, mus musculus
ttgagctcttctgtccaaagatggc

SEQ ID NO: 107233 - DNA, 25 bp, mus musculus
gtccaaagatggctgcgggctaagc

SEQ ID NO: 107234 - DNA, 25 bp, mus musculus
tgctccatctcaggaggcagccttc

SEQ ID NO: 107235 - DNA, 25 bp, mus musculus
tccatctcaggaggcagccttcctg

SEQ ID NO: 107236 - DNA, 25 bp, mus musculus
ggcagccttcctgaccaagtgtgtt

SEQ ID NO: 107237 - DNA, 25 bp, mus musculus
ctttctgcctgggatgtctgctgca

SEQ ID NO: 107238 - DNA, 25 bp, mus musculus
tctgcctgggatgtctgctgcaaag

SEQ ID NO: 107239 - DNA, 25 bp, mus musculus
tgcaaagcagtgacctctgacccct

SEQ ID NO: 107240 - DNA, 25 bp, mus musculus
aaagcagtgacctctgacccctggt

SEQ ID NO: 107241 - DNA, 25 bp, mus musculus
tctgacccctggtgacctttgctct

SEQ ID NO: 107242 - DNA, 25 bp, mus musculus
tggtgacctttgctctcggcaccgg

SEQ ID NO: 107243 - DNA, 25 bp, mus musculus
tgacctttgctctcggcaccgggcc

SEQ ID NO: 107244 - DNA, 25 bp, mus musculus
ggcctgtttcctttgctttgagtgc

SEQ ID NO: 107245 - DNA, 25 bp, mus musculus
tcactcaaagttactatcgaagcgc

SEQ ID NO: 107246 - DNA, 25 bp, mus musculus
actatcgaagcgccaatgccttgat

SEQ ID NO: 107247 - DNA, 25 bp, mus musculus
gccttcctgagtggttgcgggagat

SEQ ID NO: 107248 - DNA, 25 bp, mus musculus
aagtcatcactgtgttagtaggcaa

SEQ ID NO: 107249 - DNA, 25 bp, mus musculus
tcatcactgtgttagtaggcaacaa

SEQ ID NO: 107250 - DNA, 25 bp, mus musculus
agattgacctggctgaaaggcgaga

SEQ ID NO: 107251 - DNA, 25 bp, mus musculus
aggtctcccagcagagagcagaaga

SEQ ID NO: 107252 - DNA, 25 bp, mus musculus
aagagttctcagaggctcaggacat

SEQ ID NO: 107253 - DNA, 25 bp, mus musculus
agttctcagaggctcaggacatgta

SEQ ID NO: 107254 - DNA, 25 bp, mus musculus
tgtattacctggagacttcagccaa

SEQ ID NO: 107255 - DNA, 25 bp, mus musculus
cttcagccaaggaatccgacaatgt

SEQ ID NO: 107256 - DNA, 25 bp, mus musculus
ccaaggaatccgacaatgtggagaa

SEQ ID NO: 107257 - DNA, 25 bp, mus musculus
atcgaagcgccaatgccttgatcct

SEQ ID NO: 107258 - DNA, 25 bp, mus musculus
gcgccaatgccttgatccttaccta

SEQ ID NO: 107259 - DNA, 25 bp, mus musculus
atgccttgatccttacctatgacat

SEQ ID NO: 107260 - DNA, 25 bp, mus musculus
tgatccttacctatgacatcacctg

SEQ ID NO: 107261 - DNA, 25 bp, mus musculus
tccttacctatgacatcacctgtga

SEQ ID NO: 107262 - DNA, 25 bp, mus musculus
atgacatcacctgtgaggaatcctt

SEQ ID NO: 107263 - DNA, 25 bp, mus musculus
acatcacctgtgaggaatccttccg

SEQ ID NO: 107264 - DNA, 25 bp, mus musculus
aggaatccttccgctgccttcctga

SEQ ID NO: 107265 - DNA, 25 bp, mus musculus
ggagcgcctctgagccttacctgca

SEQ ID NO: 107266 - DNA, 25 bp, mus musculus
cctctgagccttacctgcatcggtc

SEQ ID NO: 107267 - DNA, 25 bp, mus musculus
tgattacatctccaaggctaccagt

SEQ ID NO: 107268 - DNA, 25 bp, mus musculus
catctccaaggctaccagtcttcta

SEQ ID NO: 107269 - DNA, 25 bp, mus musculus
caaggctaccagtcttctagctgat

SEQ ID NO: 107270 - DNA, 25 bp, mus musculus
ggctaccagtcttctagctgatgat

SEQ ID NO: 107271 - DNA, 25 bp, mus musculus
taccagtcttctagctgatgatgta

SEQ ID NO: 107272 - DNA, 25 bp, mus musculus
cagtcttctagctgatgatgtagct

SEQ ID NO: 107273 - DNA, 25 bp, mus musculus
tcttctagctgatgatgtagctgtt

SEQ ID NO: 107274 - DNA, 25 bp, mus musculus
tgtagctgttcttaggccaacaggg

SEQ ID NO: 107275 - DNA, 25 bp, mus musculus
tcttaggccaacaggggacgaagat

SEQ ID NO: 107276 - DNA, 25 bp, mus musculus
gtcagcaggtaccactttcgtgtct

SEQ ID NO: 107277 - DNA, 25 bp, mus musculus
agccttacctgcatcggtcagctca

SEQ ID NO: 107278 - DNA, 25 bp, mus musculus
cttacctgcatcggtcagctcacac

SEQ ID NO: 107279 - DNA, 25 bp, mus musculus
acctgcatcggtcagctcacactga

SEQ ID NO: 107280 - DNA, 25 bp, mus musculus
ggtcagctcacactgaggacatcag

SEQ ID NO: 107281 - DNA, 25 bp, mus musculus
acatcagtgcttgcacgctgattac

SEQ ID NO: 107282 - DNA, 25 bp, mus musculus
tcagtgcttgcacgctgattacatc

SEQ ID NO: 107283 - DNA, 25 bp, mus musculus
gcacgctgattacatctccaaggct

SEQ ID NO: 107284 - DNA, 25 bp, mus musculus
cgctgattacatctccaaggctacc

SEQ ID NO: 107285 - DNA, 25 bp, mus musculus
cctattacaacctcgaggaatcatg

SEQ ID NO: 107286 - DNA, 25 bp, mus musculus
acaacctcgaggaatcatgcacccg

SEQ ID NO: 107287 - DNA, 25 bp, mus musculus
gagaaaagcccaacaccagctacat

SEQ ID NO: 107288 - DNA, 25 bp, mus musculus
ccaacaccagctacatcattgggaa

SEQ ID NO: 107289 - DNA, 25 bp, mus musculus
acaccagctacatcattgggaagga

SEQ ID NO: 107290 - DNA, 25 bp, mus musculus
ccagctacatcattgggaaggacac

SEQ ID NO: 107291 - DNA, 25 bp, mus musculus
cattcacagaatctatggtggttta

SEQ ID NO: 107292 - DNA, 25 bp, mus musculus
atggttgtcccaactgactacagcc

SEQ ID NO: 107293 - DNA, 25 bp, mus musculus
gttgtcccaactgactacagcccag

SEQ ID NO: 107294 - DNA, 25 bp, mus musculus
ccagccctctaataaagcttcagtt

SEQ ID NO: 107295 - DNA, 25 bp, mus musculus
gccctctaataaagcttcagttgta

SEQ ID NO: 107296 - DNA, 25 bp, mus musculus
ctctaataaagcttcagttgtattt

SEQ ID NO: 107297 - DNA, 25 bp, mus musculus
aggaatcatgcacccggttctatca

SEQ ID NO: 107298 - DNA, 25 bp, mus musculus
aaatgtgccggtgtgctgaagagaa

SEQ ID NO: 107299 - DNA, 25 bp, mus musculus
gcagaaacgccctgaagctgcagaa

SEQ ID NO: 107300 - DNA, 25 bp, mus musculus
gaaacgccctgaagctgcagaaagg

SEQ ID NO: 107301 - DNA, 25 bp, mus musculus
acgccctgaagctgcagaaagggaa

SEQ ID NO: 107302 - DNA, 25 bp, mus musculus
ccctgaagctgcagaaagggaagaa

SEQ ID NO: 107303 - DNA, 25 bp, mus musculus
agaagtacctcatgtggggcctctc

SEQ ID NO: 107304 - DNA, 25 bp, mus musculus
tctcctctgacctctggggagaaaa

SEQ ID NO: 107305 - DNA, 25 bp, mus musculus
cagcatgcaacctcaggcccaggtc

SEQ ID NO: 107306 - DNA, 25 bp, mus musculus
gcatgcaacctcaggcccaggtcct

SEQ ID NO: 107307 - DNA, 25 bp, mus musculus
cctgctcaaggacaaaggggagcac

SEQ ID NO: 107308 - DNA, 25 bp, mus musculus
agcacctgtgccagctagaagctcc

SEQ ID NO: 107309 - DNA, 25 bp, mus musculus
cacctgtgccagctagaagctccca

SEQ ID NO: 107310 - DNA, 25 bp, mus musculus
cctgtgccagctagaagctcccatg

SEQ ID NO: 107311 - DNA, 25 bp, mus musculus
tgtgccagctagaagctcccatggc

SEQ ID NO: 107312 - DNA, 25 bp, mus musculus
tgccagctagaagctcccatggcaa

SEQ ID NO: 107313 - DNA, 25 bp, mus musculus
ccagctagaagctcccatggcaatg

SEQ ID NO: 107314 - DNA, 25 bp, mus musculus
agctagaagctcccatggcaatgag

SEQ ID NO: 107315 - DNA, 25 bp, mus musculus
ctagaagctcccatggcaatgagca

SEQ ID NO: 107316 - DNA, 25 bp, mus musculus
agaagctcccatggcaatgagcatc

SEQ ID NO: 107317 - DNA, 25 bp, mus musculus
cctgctgatgtcagcaaggtagtag

SEQ ID NO: 107318 - DNA, 25 bp, mus musculus
aagctcccatggcaatgagcatccc

SEQ ID NO: 107319 - DNA, 25 bp, mus musculus
gccaaaggcctggggctaagcaagg

SEQ ID NO: 107320 - DNA, 25 bp, mus musculus
caaaggcctggggctaagcaaggct

SEQ ID NO: 107321 - DNA, 25 bp, mus musculus
agagcaacttcacagtagattgcag

SEQ ID NO: 107322 - DNA, 25 bp, mus musculus
caacttcacagtagattgcagcaaa

SEQ ID NO: 107323 - DNA, 25 bp, mus musculus
caggtaacaacatgctgctggtggg

SEQ ID NO: 107324 - DNA, 25 bp, mus musculus
gaaacacatgggcagccgcctgtat

SEQ ID NO: 107325 - DNA, 25 bp, mus musculus
aacacatgggcagccgcctgtatag

SEQ ID NO: 107326 - DNA, 25 bp, mus musculus
tgtgaaacaccagctttcctcaaac

SEQ ID NO: 107327 - DNA, 25 bp, mus musculus
ctcactcctaaaccagaggaggtgt

SEQ ID NO: 107328 - DNA, 25 bp, mus musculus
cttcatcctgcatcctggcaggcat

SEQ ID NO: 107329 - DNA, 25 bp, mus musculus
cctgcatcctggcaggcatttcaca

SEQ ID NO: 107330 - DNA, 25 bp, mus musculus
tcctggcaggcatttcacacctgag

SEQ ID NO: 107331 - DNA, 25 bp, mus musculus
caggcatttcacacctgagcacaca

SEQ ID NO: 107332 - DNA, 25 bp, mus musculus
tttcacacctgagcacacacaggca

SEQ ID NO: 107333 - DNA, 25 bp, mus musculus
acctgagcacacacaggcaacttcc

SEQ ID NO: 107334 - DNA, 25 bp, mus musculus
ccagctcctctcgagctgtgacaca

SEQ ID NO: 107335 - DNA, 25 bp, mus musculus
agactcggaccactatgcttgaagt

SEQ ID NO: 107336 - DNA, 25 bp, mus musculus
ggaccactatgcttgaagtgacatt

SEQ ID NO: 107337 - DNA, 25 bp, mus musculus
tttaagactactaaggccttctgtg

SEQ ID NO: 107338 - DNA, 25 bp, mus musculus
aacccattcctaaacatggtgtctg

SEQ ID NO: 107339 - DNA, 25 bp, mus musculus
ctaataaacctgtaagctttgctgc

SEQ ID NO: 107340 - DNA, 25 bp, mus musculus
ttcctaaacatggtgtctgataatg

SEQ ID NO: 107341 - DNA, 25 bp, mus musculus
tggcgcttcttgcttctgctctgcg

SEQ ID NO: 107342 - DNA, 25 bp, mus musculus
cttctgctctgcgtggagtattttc

SEQ ID NO: 107343 - DNA, 25 bp, mus musculus
ttgcaacactaaccacagactgaat

SEQ ID NO: 107344 - DNA, 25 bp, mus musculus
cactaaccacagactgaatgactga

SEQ ID NO: 107345 - DNA, 25 bp, mus musculus
tgactgacttcccgtacgacagcca

SEQ ID NO: 107346 - DNA, 25 bp, mus musculus
tttgttagcctccttcatcctgcat

SEQ ID NO: 107347 - DNA, 25 bp, mus musculus
tttctagtactggacatcaacccag

SEQ ID NO: 107348 - DNA, 25 bp, mus musculus
ctggacatcaacccagtgccttgta

SEQ ID NO: 107349 - DNA, 25 bp, mus musculus
cctttgccacttcatgtcatcatag

SEQ ID NO: 107350 - DNA, 25 bp, mus musculus
ttgccacttcatgtcatcatagaat

SEQ ID NO: 107351 - DNA, 25 bp, mus musculus
ctctagcggttcaaggtatgtattt

SEQ ID NO: 107352 - DNA, 25 bp, mus musculus
tgtatagcagtcacacctttgataa

SEQ ID NO: 107353 - DNA, 25 bp, mus musculus
atttcagtcttgcttattgtgaagc

SEQ ID NO: 107354 - DNA, 25 bp, mus musculus
tcagtcttgcttattgtgaagcttt

SEQ ID NO: 107355 - DNA, 25 bp, mus musculus
tgaaattgtcctgttgctacatcat

SEQ ID NO: 107356 - DNA, 25 bp, mus musculus
cctgttgctacatcattctgttaag

SEQ ID NO: 107357 - DNA, 25 bp, mus musculus
gttgctacatcattctgttaagaaa

SEQ ID NO: 107358 - DNA, 25 bp, mus musculus
gctacatcattctgttaagaaataa

SEQ ID NO: 107359 - DNA, 25 bp, mus musculus
aatgcaagcattttcttgtactctg

SEQ ID NO: 107360 - DNA, 25 bp, mus musculus
agcattttcttgtactctgctacct

SEQ ID NO: 107361 - DNA, 25 bp, mus musculus
ctacccaacaaatgttcattacagc

SEQ ID NO: 107362 - DNA, 25 bp, mus musculus
tgttcattacagctgacaagggtct

SEQ ID NO: 107363 - DNA, 25 bp, mus musculus
ttacagctgacaagggtctttataa

SEQ ID NO: 107364 - DNA, 25 bp, mus musculus
gtgtttccctttatcacaatacaat

SEQ ID NO: 107365 - DNA, 25 bp, mus musculus
tttatcacaatacaattccctcctt

SEQ ID NO: 107366 - DNA, 25 bp, mus musculus
atcacaatacaattccctcctttgc

SEQ ID NO: 107367 - DNA, 25 bp, mus musculus
ctccgggatctaccagccttggctc

SEQ ID NO: 107368 - DNA, 25 bp, mus musculus
gatctaccagccttggctcacagcc

SEQ ID NO: 107369 - DNA, 25 bp, mus musculus
ccacccaaggatgcatgcagtgtgc

SEQ ID NO: 107370 - DNA, 25 bp, mus musculus
gcatgcagtgtgcttctgtctagac

SEQ ID NO: 107371 - DNA, 25 bp, mus musculus
tctatcaaatccataactgccacct

SEQ ID NO: 107372 - DNA, 25 bp, mus musculus
ttttaagaccctgacggcagctggc

SEQ ID NO: 107373 - DNA, 25 bp, mus musculus
gaccctgacggcagctggcacacag

SEQ ID NO: 107374 - DNA, 25 bp, mus musculus
cacacagctcatggctctagccaaa

SEQ ID NO: 107375 - DNA, 25 bp, mus musculus
gctcatggctctagccaaacccaca

SEQ ID NO: 107376 - DNA, 25 bp, mus musculus
ggctctagccaaacccacagcaaag

SEQ ID NO: 107377 - DNA, 25 bp, mus musculus
cattgacagtggcgtcctacaacct

SEQ ID NO: 107378 - DNA, 25 bp, mus musculus
cagtggcgtcctacaacctgtgtca

SEQ ID NO: 107379 - DNA, 25 bp, mus musculus
cataaacatcatgctaccaggtgtc

SEQ ID NO: 107380 - DNA, 25 bp, mus musculus
catcatgctaccaggtgtccccaac

SEQ ID NO: 107381 - DNA, 25 bp, mus musculus
gcttcccctggcaacaggctgctca

SEQ ID NO: 107382 - DNA, 25 bp, mus musculus
aacaggctgctcaccttcctgcagt

SEQ ID NO: 107383 - DNA, 25 bp, mus musculus
accttcctgcagtcttcctaaaatg

SEQ ID NO: 107384 - DNA, 25 bp, mus musculus
ctgcagtcttcctaaaatgaggcag

SEQ ID NO: 107385 - DNA, 25 bp, mus musculus
tcttcctaaaatgaggcagagtcta

SEQ ID NO: 107386 - DNA, 25 bp, mus musculus
actgacccatttccacccaaggatg

SEQ ID NO: 107387 - DNA, 25 bp, mus musculus
ataaggacttctactcagagcacac

SEQ ID NO: 107388 - DNA, 25 bp, mus musculus
acttctactcagagcacactgtatg

SEQ ID NO: 107389 - DNA, 25 bp, mus musculus
gctgtgttaaccctatcatctacgt

SEQ ID NO: 107390 - DNA, 25 bp, mus musculus
ttaaccctatcatctacgtcatggc

SEQ ID NO: 107391 - DNA, 25 bp, mus musculus
ctatcatctacgtcatggctggcca

SEQ ID NO: 107392 - DNA, 25 bp, mus musculus
tctacgtcatggctggccagggttt

SEQ ID NO: 107393 - DNA, 25 bp, mus musculus
ctggccagggtttccatggacgact

SEQ ID NO: 107394 - DNA, 25 bp, mus musculus
tccatggacgactcctaaggtctct

SEQ ID NO: 107395 - DNA, 25 bp, mus musculus
tccccagcatcatacgaaacgctct

SEQ ID NO: 107396 - DNA, 25 bp, mus musculus
gcatcatacgaaacgctctctctga

SEQ ID NO: 107397 - DNA, 25 bp, mus musculus
tacgaaacgctctctctgaggattc

SEQ ID NO: 107398 - DNA, 25 bp, mus musculus
atagcaagactttcactccgtccac

SEQ ID NO: 107399 - DNA, 25 bp, mus musculus
gcttccccaaagagaaggctgtggc

SEQ ID NO: 107400 - DNA, 25 bp, mus musculus
tgcctctgctcactctaaacatctg

SEQ ID NO: 107401 - DNA, 25 bp, mus musculus
tgctcactctaaacatctgctacac

SEQ ID NO: 107402 - DNA, 25 bp, mus musculus
ctctaaacatctgctacaccttcct

SEQ ID NO: 107403 - DNA, 25 bp, mus musculus
tcctgctccggacctggagtcgcaa

SEQ ID NO: 107404 - DNA, 25 bp, mus musculus
tccggacctggagtcgcaaggccac

SEQ ID NO: 107405 - DNA, 25 bp, mus musculus
ccaccaagacgctcaaagtggtgat

SEQ ID NO: 107406 - DNA, 25 bp, mus musculus
cctatcaggtgaccggggtgatgat

SEQ ID NO: 107407 - DNA, 25 bp, mus musculus
attgtagactctcagtttctgcttt

SEQ ID NO: 107408 - DNA, 25 bp, mus musculus
gtagactctcagtttctgctttcag

SEQ ID NO: 107409 - DNA, 25 bp, mus musculus
acatctgtgcctgatatcagacgct

SEQ ID NO: 107410 - DNA, 25 bp, mus musculus
tctgtgcctgatatcagacgctgcc

SEQ ID NO: 107411 - DNA, 25 bp, mus musculus
tgccagctgacccccaatgacaggt

SEQ ID NO: 107412 - DNA, 25 bp, mus musculus
ttgctggcttgcgacgggcttttca

SEQ ID NO: 107413 - DNA, 25 bp, mus musculus
gcttgcgacgggcttttcaaggtct

SEQ ID NO: 107414 - DNA, 25 bp, mus musculus
tttaccccagaagaagctgtgaact

SEQ ID NO: 107415 - DNA, 25 bp, mus musculus
gctgtgaacttcatcttgtcctgcc

SEQ ID NO: 107416 - DNA, 25 bp, mus musculus
gtgaacttcatcttgtcctgccttg

SEQ ID NO: 107417 - DNA, 25 bp, mus musculus
ttcatcttgtcctgccttgaggatg

SEQ ID NO: 107418 - DNA, 25 bp, mus musculus
atcttgtcctgccttgaggatgaca

SEQ ID NO: 107419 - DNA, 25 bp, mus musculus
tttctgctttcagggacctgtgagg

SEQ ID NO: 107420 - DNA, 25 bp, mus musculus
acagtctgacgttattcccttcatt

SEQ ID NO: 107421 - DNA, 25 bp, mus musculus
tgacgttattcccttcattttagag

SEQ ID NO: 107422 - DNA, 25 bp, mus musculus
cgttattcccttcattttagagatg

SEQ ID NO: 107423 - DNA, 25 bp, mus musculus
tattcccttcattttagagatgggc

SEQ ID NO: 107424 - DNA, 25 bp, mus musculus
gtatcgcgttccattggagatgggc

SEQ ID NO: 107425 - DNA, 25 bp, mus musculus
tcgcgttccattggagatgggcagt

SEQ ID NO: 107426 - DNA, 25 bp, mus musculus
tacaagcgctgtggggtcacatctg

SEQ ID NO: 107427 - DNA, 25 bp, mus musculus
gtcctgttgtccatggactccttct

SEQ ID NO: 107428 - DNA, 25 bp, mus musculus
ttgtccatggactccttctataagg

SEQ ID NO: 107429 - DNA, 25 bp, mus musculus
ttcgatctcatcatttccaccctta

SEQ ID NO: 107430 - DNA, 25 bp, mus musculus
agtgtccaagtgcccatctatgatt

SEQ ID NO: 107431 - DNA, 25 bp, mus musculus
cccatctatgatttcactacccata

SEQ ID NO: 107432 - DNA, 25 bp, mus musculus
atctatgatttcactacccatagcc

SEQ ID NO: 107433 - DNA, 25 bp, mus musculus
tggaaaaccctgtatggtgcgaatg

SEQ ID NO: 107434 - DNA, 25 bp, mus musculus
accctgtatggtgcgaatgtcatca

SEQ ID NO: 107435 - DNA, 25 bp, mus musculus
aatgtcatcatctttgagggtatca

SEQ ID NO: 107436 - DNA, 25 bp, mus musculus
gtcatcatctttgagggtatcatgg

SEQ ID NO: 107437 - DNA, 25 bp, mus musculus
atcatggcctttgctgataagacac

SEQ ID NO: 107438 - DNA, 25 bp, mus musculus
atggcctttgctgataagacactgc

SEQ ID NO: 107439 - DNA, 25 bp, mus musculus
tccttctataaggttctgacgcagc

SEQ ID NO: 107440 - DNA, 25 bp, mus musculus
aaggttctgacgcagcagcagcagg

SEQ ID NO: 107441 - DNA, 25 bp, mus musculus
gaacaggctgcctgtaacaatttca

SEQ ID NO: 107442 - DNA, 25 bp, mus musculus
caggctgcctgtaacaatttcaact

SEQ ID NO: 107443 - DNA, 25 bp, mus musculus
ttcaactttgaccaccctgatgcct

SEQ ID NO: 107444 - DNA, 25 bp, mus musculus
gatgcctttgacttcgatctcatca

SEQ ID NO: 107445 - DNA, 25 bp, mus musculus
tttgacttcgatctcatcatttcca

SEQ ID NO: 107446 - DNA, 25 bp, mus musculus
gacttcgatctcatcatttccaccc

SEQ ID NO: 107447 - DNA, 25 bp, mus musculus
atgagctgtaccaatgccaacctgg

SEQ ID NO: 107448 - DNA, 25 bp, mus musculus
gttctgcagatcaaacacaatttca

SEQ ID NO: 107449 - DNA, 25 bp, mus musculus
tttttaaacagctgtgaatgaaaag

SEQ ID NO: 107450 - DNA, 25 bp, mus musculus
tgaaaagttctgctgcacgaagatt

SEQ ID NO: 107451 - DNA, 25 bp, mus musculus
gttctgctgcacgaagattcctcct

SEQ ID NO: 107452 - DNA, 25 bp, mus musculus
tggaaacctagcctagaatcagata

SEQ ID NO: 107453 - DNA, 25 bp, mus musculus
tcagatacactttctttagagtaaa

SEQ ID NO: 107454 - DNA, 25 bp, mus musculus
ggtcccccaaggctatcagatgtca

SEQ ID NO: 107455 - DNA, 25 bp, mus musculus
gagacccactgaaactgtagcccct

SEQ ID NO: 107456 - DNA, 25 bp, mus musculus
cactgaaactgtagccccttatcaa

SEQ ID NO: 107457 - DNA, 25 bp, mus musculus
agccccttatcaaaacatatccttg

SEQ ID NO: 107458 - DNA, 25 bp, mus musculus
ttatcaaaacatatccttgcttgaa

SEQ ID NO: 107459 - DNA, 25 bp, mus musculus
aagtatatataccctctagattcct

SEQ ID NO: 107460 - DNA, 25 bp, mus musculus
tccacctggattgaatattggccca

SEQ ID NO: 107461 - DNA, 25 bp, mus musculus
tggcccacagacacaacgtgtccat

SEQ ID NO: 107462 - DNA, 25 bp, mus musculus
acagacacaacgtgtccatcctgtc

SEQ ID NO: 107463 - DNA, 25 bp, mus musculus
acaacgtgtccatcctgtcaagcat

SEQ ID NO: 107464 - DNA, 25 bp, mus musculus
tgtccatcctgtcaagcatttgtag

SEQ ID NO: 107465 - DNA, 25 bp, mus musculus
gctgaagacctctttttaaacagct

SEQ ID NO: 107466 - DNA, 25 bp, mus musculus
gacctctttttaaacagctgtgaat

SEQ ID NO: 107467 - DNA, 25 bp, mus musculus
agaaccggaggctgaagcaggccaa

SEQ ID NO: 107468 - DNA, 25 bp, mus musculus
agaagcccaggctgaaattgaacag

SEQ ID NO: 107469 - DNA, 25 bp, mus musculus
aagatgaccgtcctccagaactact

SEQ ID NO: 107470 - DNA, 25 bp, mus musculus
gatgaccgtcctccagaactacttc

SEQ ID NO: 107471 - DNA, 25 bp, mus musculus
tcctccagaactacttcgagcagaa

SEQ ID NO: 107472 - DNA, 25 bp, mus musculus
ctccagaactacttcgagcagaaca

SEQ ID NO: 107473 - DNA, 25 bp, mus musculus
agaactacttcgagcagaacaggga

SEQ ID NO: 107474 - DNA, 25 bp, mus musculus
aactacttcgagcagaacagggatg

SEQ ID NO: 107475 - DNA, 25 bp, mus musculus
tcctggataacctcttggcctttgt

SEQ ID NO: 107476 - DNA, 25 bp, mus musculus
ggataacctcttggcctttgtgtgt

SEQ ID NO: 107477 - DNA, 25 bp, mus musculus
cctcttggcctttgtgtgtgacatc

SEQ ID NO: 107478 - DNA, 25 bp, mus musculus
ttggcctttgtgtgtgacatccggc

SEQ ID NO: 107479 - DNA, 25 bp, mus musculus
aaattgaacagtaccgcctgcagag

SEQ ID NO: 107480 - DNA, 25 bp, mus musculus
cctttgtgtgtgacatccggccgga

SEQ ID NO: 107481 - DNA, 25 bp, mus musculus
attgaacagtaccgcctgcagaggg

SEQ ID NO: 107482 - DNA, 25 bp, mus musculus
aacagtaccgcctgcagagggagaa

SEQ ID NO: 107483 - DNA, 25 bp, mus musculus
cagtaccgcctgcagagggagaagg

SEQ ID NO: 107484 - DNA, 25 bp, mus musculus
aagctgcggcattgggctcccatgg

SEQ ID NO: 107485 - DNA, 25 bp, mus musculus
gcattgggctcccatggcagctgca

SEQ ID NO: 107486 - DNA, 25 bp, mus musculus
attgggctcccatggcagctgcagc

SEQ ID NO: 107487 - DNA, 25 bp, mus musculus
agaagatgaccgtcctccagaacta

SEQ ID NO: 107488 - DNA, 25 bp, mus musculus
ccacctcgctgtaaaaatggtgtgt

SEQ ID NO: 107489 - DNA, 25 bp, mus musculus
atgtttatcagcatagactatggag

SEQ ID NO: 107490 - DNA, 25 bp, mus musculus
gacttctgaaacagctttgcgtctg

SEQ ID NO: 107491 - DNA, 25 bp, mus musculus
tctgaaacagctttgcgtctgtgtt

SEQ ID NO: 107492 - DNA, 25 bp, mus musculus
tgaaacagctttgcgtctgtgttgt

SEQ ID NO: 107493 - DNA, 25 bp, mus musculus
acagctttgcgtctgtgttgtgtac

SEQ ID NO: 107494 - DNA, 25 bp, mus musculus
agctttgcgtctgtgttgtgtacca

SEQ ID NO: 107495 - DNA, 25 bp, mus musculus
ttgcgtctgtgttgtgtaccagaat

SEQ ID NO: 107496 - DNA, 25 bp, mus musculus
gcgtctgtgttgtgtaccagaatac

SEQ ID NO: 107497 - DNA, 25 bp, mus musculus
agaatacaaacaatacacctctgac

SEQ ID NO: 107498 - DNA, 25 bp, mus musculus
tacaaacaatacacctctgacccca

SEQ ID NO: 107499 - DNA, 25 bp, mus musculus
ctctgaccccagcgttctgaataaa

SEQ ID NO: 107500 - DNA, 25 bp, mus musculus
ttatcagcatagactatggaggagt

SEQ ID NO: 107501 - DNA, 25 bp, mus musculus
atttgattcaactgttgagctgtag

SEQ ID NO: 107502 - DNA, 25 bp, mus musculus
gattcaactgttgagctgtagttag

SEQ ID NO: 107503 - DNA, 25 bp, mus musculus
aagttcttagcacaatgttttacat

SEQ ID NO: 107504 - DNA, 25 bp, mus musculus
gttcttagcacaatgttttacataa

SEQ ID NO: 107505 - DNA, 25 bp, mus musculus
ggcctgtttcttgcagcactagcaa

SEQ ID NO: 107506 - DNA, 25 bp, mus musculus
cctgtttcttgcagcactagcaagt

SEQ ID NO: 107507 - DNA, 25 bp, mus musculus
gagacttctgaaacagctttgcgtc

SEQ ID NO: 107508 - DNA, 25 bp, mus musculus
aaagtgtgacctgggtgatctgcaa

SEQ ID NO: 107509 - DNA, 25 bp, mus musculus
gtgtgacctgggtgatctgcaagga

SEQ ID NO: 107510 - DNA, 25 bp, mus musculus
tacagcagcatccaataaagggatc

SEQ ID NO: 107511 - DNA, 25 bp, mus musculus
atttaatccacagaactaaaatgct

SEQ ID NO: 107512 - DNA, 25 bp, mus musculus
taatccacagaactaaaatgctttc

SEQ ID NO: 107513 - DNA, 25 bp, mus musculus
atactctataagtttgcctactgta

SEQ ID NO: 107514 - DNA, 25 bp, mus musculus
ctttctgctctcttcactttaaata

SEQ ID NO: 107515 - DNA, 25 bp, mus musculus
agcgctgatagcagccttccagttc

SEQ ID NO: 107516 - DNA, 25 bp, mus musculus
gctgatagcagccttccagttctgt

SEQ ID NO: 107517 - DNA, 25 bp, mus musculus
agcagccttccagttctgttcaagt

SEQ ID NO: 107518 - DNA, 25 bp, mus musculus
agccttccagttctgttcaagtata

SEQ ID NO: 107519 - DNA, 25 bp, mus musculus
cttccagttctgttcaagtatatgg

SEQ ID NO: 107520 - DNA, 25 bp, mus musculus
tcagtctaagcccagagcagctggc

SEQ ID NO: 107521 - DNA, 25 bp, mus musculus
gtctaagcccagagcagctggccca

SEQ ID NO: 107522 - DNA, 25 bp, mus musculus
tccgtggtcttctgtcaagtgcaga

SEQ ID NO: 107523 - DNA, 25 bp, mus musculus
agtctgcagttccagttctgagcaa

SEQ ID NO: 107524 - DNA, 25 bp, mus musculus
cagttccagttctgagcaaccaccg

SEQ ID NO: 107525 - DNA, 25 bp, mus musculus
tcagagcctcattttgagtcccagc

SEQ ID NO: 107526 - DNA, 25 bp, mus musculus
gagtcccagcaaggaatgagtcctc

SEQ ID NO: 107527 - DNA, 25 bp, mus musculus
atgagtcctcaattatgacctggcc

SEQ ID NO: 107528 - DNA, 25 bp, mus musculus
cctcaggtgtcagatcccctgaaac

SEQ ID NO: 107529 - DNA, 25 bp, mus musculus
gtgtcagatcccctgaaactgaagt

SEQ ID NO: 107530 - DNA, 25 bp, mus musculus
tgctcttaactgttgagccacctct

SEQ ID NO: 107531 - DNA, 25 bp, mus musculus
tccagcctcaccaagtcttatctga

SEQ ID NO: 107532 - DNA, 25 bp, mus musculus
agcctcaccaagtcttatctgataa

SEQ ID NO: 107533 - DNA, 25 bp, mus musculus
ctcaccaagtcttatctgataatga

SEQ ID NO: 107534 - DNA, 25 bp, mus musculus
tgaatagatctcctcctgtccatct

SEQ ID NO: 107535 - DNA, 25 bp, mus musculus
atagatctcctcctgtccatctctg

SEQ ID NO: 107536 - DNA, 25 bp, mus musculus
ctcctgtccatctctggactataag

SEQ ID NO: 107537 - DNA, 25 bp, mus musculus
ctgtccatctctggactataagtac

SEQ ID NO: 107538 - DNA, 25 bp, mus musculus
tccatctctggactataagtactac

SEQ ID NO: 107539 - DNA, 25 bp, mus musculus
ggacatcaatgcaagcctgaagaaa

SEQ ID NO: 107540 - DNA, 25 bp, mus musculus
tcagatcccctgaaactgaagttac

SEQ ID NO: 107541 - DNA, 25 bp, mus musculus
gatcccctgaaactgaagttacaga

SEQ ID NO: 107542 - DNA, 25 bp, mus musculus
tggaatcaaacctgggtcctctgga

SEQ ID NO: 107543 - DNA, 25 bp, mus musculus
caaacctgggtcctctggaagagct

SEQ ID NO: 107544 - DNA, 25 bp, mus musculus
gtcctctggaagagctgccagtgct

SEQ ID NO: 107545 - DNA, 25 bp, mus musculus
aagagctgccagtgctcttaactgt

SEQ ID NO: 107546 - DNA, 25 bp, mus musculus
agctgccagtgctcttaactgttga

SEQ ID NO: 107547 - DNA, 25 bp, mus musculus
cagtgctcttaactgttgagccacc

SEQ ID NO: 107548 - DNA, 25 bp, mus musculus
cttttacacactttgacccatcatg

SEQ ID NO: 107549 - DNA, 25 bp, mus musculus
cacactttgacccatcatgcctgtt

SEQ ID NO: 107550 - DNA, 25 bp, mus musculus
cagagaatgagcccccggtgcctct

SEQ ID NO: 107551 - DNA, 25 bp, mus musculus
ccctgaagagcctgcttgtctcctc

SEQ ID NO: 107552 - DNA, 25 bp, mus musculus
agagcctgcttgtctcctcctgtgc

SEQ ID NO: 107553 - DNA, 25 bp, mus musculus
tgcttgtctcctcctgtgctcccta

SEQ ID NO: 107554 - DNA, 25 bp, mus musculus
actccaagctgtccgacgaacacct

SEQ ID NO: 107555 - DNA, 25 bp, mus musculus
gaagcagtcacatgcaaccgcagtg

SEQ ID NO: 107556 - DNA, 25 bp, mus musculus
tgcaaccgcagtgccttttgacatg

SEQ ID NO: 107557 - DNA, 25 bp, mus musculus
cgcagtgccttttgacatgatctca

SEQ ID NO: 107558 - DNA, 25 bp, mus musculus
aagcatgaatttcacacctaacatt

SEQ ID NO: 107559 - DNA, 25 bp, mus musculus
gaatttcacacctaacattcttaat

SEQ ID NO: 107560 - DNA, 25 bp, mus musculus
ttgacccatcatgcctgttccctgc

SEQ ID NO: 107561 - DNA, 25 bp, mus musculus
tccctgcttgccgggactattggac

SEQ ID NO: 107562 - DNA, 25 bp, mus musculus
cttgccgggactattggacctatca

SEQ ID NO: 107563 - DNA, 25 bp, mus musculus
ttgtgtggctgctgctcaaagagcc

SEQ ID NO: 107564 - DNA, 25 bp, mus musculus
aagagcccatgactgtgagctcaga

SEQ ID NO: 107565 - DNA, 25 bp, mus musculus
ctgtgagctcagaccagatggccaa

SEQ ID NO: 107566 - DNA, 25 bp, mus musculus
gctcagaccagatggccaagctgcg

SEQ ID NO: 107567 - DNA, 25 bp, mus musculus
tcttctccagcgcagagaatgagcc

SEQ ID NO: 107568 - DNA, 25 bp, mus musculus
gtccaacagacagttacgcagccat

SEQ ID NO: 107569 - DNA, 25 bp, mus musculus
ccaacagacagttacgcagccattt

SEQ ID NO: 107570 - DNA, 25 bp, mus musculus
agcgcctggaagccctcgatgccaa

SEQ ID NO: 107571 - DNA, 25 bp, mus musculus
cgcctggaagccctcgatgccaatt

SEQ ID NO: 107572 - DNA, 25 bp, mus musculus
cctggaagccctcgatgccaattct

SEQ ID NO: 107573 - DNA, 25 bp, mus musculus
gaagccctcgatgccaattctcgga

SEQ ID NO: 107574 - DNA, 25 bp, mus musculus
ctcgatgccaattctcggaagcaag

SEQ ID NO: 107575 - DNA, 25 bp, mus musculus
cgatgccaattctcggaagcaagaa

SEQ ID NO: 107576 - DNA, 25 bp, mus musculus
atgccaattctcggaagcaagaagc

SEQ ID NO: 107577 - DNA, 25 bp, mus musculus
gccaattctcggaagcaagaagcgg

SEQ ID NO: 107578 - DNA, 25 bp, mus musculus
caattctcggaagcaagaagcggag

SEQ ID NO: 107579 - DNA, 25 bp, mus musculus
caaacaacagggcagcagaagaagc

SEQ ID NO: 107580 - DNA, 25 bp, mus musculus
aacagacagttacgcagccatttca

SEQ ID NO: 107581 - DNA, 25 bp, mus musculus
cagacagttacgcagccatttcaga

SEQ ID NO: 107582 - DNA, 25 bp, mus musculus
gacagttacgcagccatttcagaag

SEQ ID NO: 107583 - DNA, 25 bp, mus musculus
cagttacgcagccatttcagaagtg

SEQ ID NO: 107584 - DNA, 25 bp, mus musculus
gcagacagagcgcctggaagccctc

SEQ ID NO: 107585 - DNA, 25 bp, mus musculus
agacagagcgcctggaagccctcga

SEQ ID NO: 107586 - DNA, 25 bp, mus musculus
acagagcgcctggaagccctcgatg

SEQ ID NO: 107587 - DNA, 25 bp, mus musculus
agagcgcctggaagccctcgatgcc

SEQ ID NO: 107588 - DNA, 25 bp, mus musculus
gtgccataccacacgtttatgaagc

SEQ ID NO: 107589 - DNA, 25 bp, mus musculus
gccataccacacgtttatgaagcag

SEQ ID NO: 107590 - DNA, 25 bp, mus musculus
ccttcaagcgactacagacccgata

SEQ ID NO: 107591 - DNA, 25 bp, mus musculus
ttcaagcgactacagacccgatact

SEQ ID NO: 107592 - DNA, 25 bp, mus musculus
caagcgactacagacccgatactgc

SEQ ID NO: 107593 - DNA, 25 bp, mus musculus
agcgactacagacccgatactgcaa

SEQ ID NO: 107594 - DNA, 25 bp, mus musculus
cgactacagacccgatactgcaatt

SEQ ID NO: 107595 - DNA, 25 bp, mus musculus
actacagacccgatactgcaattga

SEQ ID NO: 107596 - DNA, 25 bp, mus musculus
tacagacccgatactgcaattgatg

SEQ ID NO: 107597 - DNA, 25 bp, mus musculus
cagacccgatactgcaattgatgct

SEQ ID NO: 107598 - DNA, 25 bp, mus musculus
gacccgatactgcaattgatgctgc

SEQ ID NO: 107599 - DNA, 25 bp, mus musculus
ttgttccaggctggagagcccaacg

SEQ ID NO: 107600 - DNA, 25 bp, mus musculus
cataccacacgtttatgaagcagaa

SEQ ID NO: 107601 - DNA, 25 bp, mus musculus
taccacacgtttatgaagcagaata

SEQ ID NO: 107602 - DNA, 25 bp, mus musculus
agatgatgccgtgcgcgatacttca

SEQ ID NO: 107603 - DNA, 25 bp, mus musculus
atgatgccgtgcgcgatacttcatg

SEQ ID NO: 107604 - DNA, 25 bp, mus musculus
gatgccgtgcgcgatacttcatggt

SEQ ID NO: 107605 - DNA, 25 bp, mus musculus
tgccgtgcgcgatacttcatggtac

SEQ ID NO: 107606 - DNA, 25 bp, mus musculus
ccgtgcgcgatacttcatggtacta

SEQ ID NO: 107607 - DNA, 25 bp, mus musculus
ctccttcaagcgactacagacccga

SEQ ID NO: 107608 - DNA, 25 bp, mus musculus
gaccttttacctctcatccgttgtg

SEQ ID NO: 107609 - DNA, 25 bp, mus musculus
ctcatccgttgtgcttactaacaaa

SEQ ID NO: 107610 - DNA, 25 bp, mus musculus
gacatggcctcttgcttctcttcac

SEQ ID NO: 107611 - DNA, 25 bp, mus musculus
tcttcacagccataggataatgaat

SEQ ID NO: 107612 - DNA, 25 bp, mus musculus
aatgaatactcaggcctgtttgtta

SEQ ID NO: 107613 - DNA, 25 bp, mus musculus
attaattacaagtccacatcatgag

SEQ ID NO: 107614 - DNA, 25 bp, mus musculus
tccacatcatgagacaaactgaagt

SEQ ID NO: 107615 - DNA, 25 bp, mus musculus
agatgaatgttcacccttccaagat

SEQ ID NO: 107616 - DNA, 25 bp, mus musculus
tatatttcccttcagataacatacc

SEQ ID NO: 107617 - DNA, 25 bp, mus musculus
tcccttcagataacataccacaaca

SEQ ID NO: 107618 - DNA, 25 bp, mus musculus
cagataacataccacaacacaatgg

SEQ ID NO: 107619 - DNA, 25 bp, mus musculus
acataccacaacacaatggataatg

SEQ ID NO: 107620 - DNA, 25 bp, mus musculus
aagacccaggtgtctcatgtggtgg

SEQ ID NO: 107621 - DNA, 25 bp, mus musculus
tctcatgtggtggcagcacagtggc

SEQ ID NO: 107622 - DNA, 25 bp, mus musculus
gcagcacagtggcaggccagtggtc

SEQ ID NO: 107623 - DNA, 25 bp, mus musculus
cagtggcaggccagtggtcaactta

SEQ ID NO: 107624 - DNA, 25 bp, mus musculus
caggccagtggtcaacttagggcat

SEQ ID NO: 107625 - DNA, 25 bp, mus musculus
agggcatcttttctctgccacggca

SEQ ID NO: 107626 - DNA, 25 bp, mus musculus
tcttttctctgccacggcagcgcaa

SEQ ID NO: 107627 - DNA, 25 bp, mus musculus
ctctgccacggcagcgcaatgcaaa

SEQ ID NO: 107628 - DNA, 25 bp, mus musculus
aagctcaatgacctcatcaagcggg

SEQ ID NO: 107629 - DNA, 25 bp, mus musculus
tcaatgacctcatcaagcgggccag

SEQ ID NO: 107630 - DNA, 25 bp, mus musculus
aaccaccttatcaaggtgaagctag

SEQ ID NO: 107631 - DNA, 25 bp, mus musculus
ccaccttatcaaggtgaagctagag

SEQ ID NO: 107632 - DNA, 25 bp, mus musculus
cctccaaacggaggcacgagtgact

SEQ ID NO: 107633 - DNA, 25 bp, mus musculus
tccaaacggaggcacgagtgacttc

SEQ ID NO: 107634 - DNA, 25 bp, mus musculus
cacgagtgacttccatgcctgagat

SEQ ID NO: 107635 - DNA, 25 bp, mus musculus
cgagtgacttccatgcctgagatac

SEQ ID NO: 107636 - DNA, 25 bp, mus musculus
tgacttccatgcctgagatacccta

SEQ ID NO: 107637 - DNA, 25 bp, mus musculus
acttccatgcctgagataccctaca

SEQ ID NO: 107638 - DNA, 25 bp, mus musculus
ttccatgcctgagataccctacaac

SEQ ID NO: 107639 - DNA, 25 bp, mus musculus
cagggctgctgccactttctaccca

SEQ ID NO: 107640 - DNA, 25 bp, mus musculus
aatgacctcatcaagcgggccaggc

SEQ ID NO: 107641 - DNA, 25 bp, mus musculus
tgacctcatcaagcgggccaggctg

SEQ ID NO: 107642 - DNA, 25 bp, mus musculus
acctcatcaagcgggccaggctggc

SEQ ID NO: 107643 - DNA, 25 bp, mus musculus
catcaagcgggccaggctggcagat

SEQ ID NO: 107644 - DNA, 25 bp, mus musculus
tcaagcgggccaggctggcagatgt

SEQ ID NO: 107645 - DNA, 25 bp, mus musculus
caaggatggcctgctggatgacgag

SEQ ID NO: 107646 - DNA, 25 bp, mus musculus
tggcctgctggatgacgaggagttt

SEQ ID NO: 107647 - DNA, 25 bp, mus musculus
tgccctggccaaccaccttatcaag

SEQ ID NO: 107648 - DNA, 25 bp, mus musculus
ttgttacggtccagatcatccatca

SEQ ID NO: 107649 - DNA, 25 bp, mus musculus
ttacggtccagatcatccatcagcc

SEQ ID NO: 107650 - DNA, 25 bp, mus musculus
gcatcctgcagcttggagccaatgg

SEQ ID NO: 107651 - DNA, 25 bp, mus musculus
agcttggagccaatggtgagctcct

SEQ ID NO: 107652 - DNA, 25 bp, mus musculus
atggtgagctccttctggatcccct

SEQ ID NO: 107653 - DNA, 25 bp, mus musculus
accactcctttggcgcttcgctgtc

SEQ ID NO: 107654 - DNA, 25 bp, mus musculus
cattggctccaagctgcaggatgct

SEQ ID NO: 107655 - DNA, 25 bp, mus musculus
tggctccaagctgcaggatgctgaa

SEQ ID NO: 107656 - DNA, 25 bp, mus musculus
cttccaggagtatgtcgccttcctg

SEQ ID NO: 107657 - DNA, 25 bp, mus musculus
cttggctttgatctacaatgaagct

SEQ ID NO: 107658 - DNA, 25 bp, mus musculus
gggcctctctcggtcaaatccagtg

SEQ ID NO: 107659 - DNA, 25 bp, mus musculus
cctctctcggtcaaatccagtggtg

SEQ ID NO: 107660 - DNA, 25 bp, mus musculus
tccagatcatccatcagccttgcaa

SEQ ID NO: 107661 - DNA, 25 bp, mus musculus
agatcatccatcagccttgcaattt

SEQ ID NO: 107662 - DNA, 25 bp, mus musculus
tcatccatcagccttgcaatttcag

SEQ ID NO: 107663 - DNA, 25 bp, mus musculus
atcagccttgcaatttcagcatcct

SEQ ID NO: 107664 - DNA, 25 bp, mus musculus
agccttgcaatttcagcatcctgca

SEQ ID NO: 107665 - DNA, 25 bp, mus musculus
cttgcaatttcagcatcctgcagct

SEQ ID NO: 107666 - DNA, 25 bp, mus musculus
atttcagcatcctgcagcttggagc

SEQ ID NO: 107667 - DNA, 25 bp, mus musculus
tcagcatcctgcagcttggagccaa

SEQ ID NO: 107668 - DNA, 25 bp, mus musculus
tggttacctcggactgttaagcagg

SEQ ID NO: 107669 - DNA, 25 bp, mus musculus
ttacctcggactgttaagcaggctg

SEQ ID NO: 107670 - DNA, 25 bp, mus musculus
atgaccccatggaggagagtgaaga

SEQ ID NO: 107671 - DNA, 25 bp, mus musculus
agctcgagtcagtaatccagggcat

SEQ ID NO: 107672 - DNA, 25 bp, mus musculus
ctcgagtcagtaatccagggcatca

SEQ ID NO: 107673 - DNA, 25 bp, mus musculus
tcagtaatccagggcatcatgcaag

SEQ ID NO: 107674 - DNA, 25 bp, mus musculus
cagtaatccagggcatcatgcaaga

SEQ ID NO: 107675 - DNA, 25 bp, mus musculus
gtaatccagggcatcatgcaagagt

SEQ ID NO: 107676 - DNA, 25 bp, mus musculus
taatccagggcatcatgcaagagtc

SEQ ID NO: 107677 - DNA, 25 bp, mus musculus
atccagggcatcatgcaagagtctg

SEQ ID NO: 107678 - DNA, 25 bp, mus musculus
tccagggcatcatgcaagagtctga

SEQ ID NO: 107679 - DNA, 25 bp, mus musculus
gcatcatgcaagagtctgagctgat

SEQ ID NO: 107680 - DNA, 25 bp, mus musculus
tacctcggactgttaagcaggctga

SEQ ID NO: 107681 - DNA, 25 bp, mus musculus
ctgttaagcaggctgagatgcctga

SEQ ID NO: 107682 - DNA, 25 bp, mus musculus
gagatgcctgatgaccccatggagg

SEQ ID NO: 107683 - DNA, 25 bp, mus musculus
agatgcctgatgaccccatggagga

SEQ ID NO: 107684 - DNA, 25 bp, mus musculus
atgcctgatgaccccatggaggaga

SEQ ID NO: 107685 - DNA, 25 bp, mus musculus
tgcctgatgaccccatggaggagag

SEQ ID NO: 107686 - DNA, 25 bp, mus musculus
cctgatgaccccatggaggagagtg

SEQ ID NO: 107687 - DNA, 25 bp, mus musculus
ctgatgaccccatggaggagagtga

SEQ ID NO: 107688 - DNA, 25 bp, mus musculus
tgaatcatgtctgataacggagagc

SEQ ID NO: 107689 - DNA, 25 bp, mus musculus
ccagcacctccagttcggatgagca

SEQ ID NO: 107690 - DNA, 25 bp, mus musculus
tcatctccatattctctggcacaga

SEQ ID NO: 107691 - DNA, 25 bp, mus musculus
ccatattctctggcacagaaaaagg

SEQ ID NO: 107692 - DNA, 25 bp, mus musculus
tattctctggcacagaaaaaggaag

SEQ ID NO: 107693 - DNA, 25 bp, mus musculus
ccccatctgattttgagcacaccat

SEQ ID NO: 107694 - DNA, 25 bp, mus musculus
attttgagcacaccatccatgttgg

SEQ ID NO: 107695 - DNA, 25 bp, mus musculus
ttgagcacaccatccatgttggctt

SEQ ID NO: 107696 - DNA, 25 bp, mus musculus
agcacaccatccatgttggctttga

SEQ ID NO: 107697 - DNA, 25 bp, mus musculus
ccatccatgttggctttgatgctgt

SEQ ID NO: 107698 - DNA, 25 bp, mus musculus
tccatgttggctttgatgctgttac

SEQ ID NO: 107699 - DNA, 25 bp, mus musculus
atgttggctttgatgctgttacggg

SEQ ID NO: 107700 - DNA, 25 bp, mus musculus
gcacctccagttcggatgagcagta

SEQ ID NO: 107701 - DNA, 25 bp, mus musculus
agcagtaccatttttagcaccggag

SEQ ID NO: 107702 - DNA, 25 bp, mus musculus
aagatcctttatcagccaatcacag

SEQ ID NO: 107703 - DNA, 25 bp, mus musculus
atcctttatcagccaatcacagttt

SEQ ID NO: 107704 - DNA, 25 bp, mus musculus
tatcagccaatcacagtttgaaacc

SEQ ID NO: 107705 - DNA, 25 bp, mus musculus
cagccaatcacagtttgaaaccttt

SEQ ID NO: 107706 - DNA, 25 bp, mus musculus
tgaaacctttgccttctgttccaga

SEQ ID NO: 107707 - DNA, 25 bp, mus musculus
aaatcatctccatattctctggcac

SEQ ID NO: 107708 - DNA, 25 bp, mus musculus
ccatgtcacagaccaaaacagcgaa

SEQ ID NO: 107709 - DNA, 25 bp, mus musculus
aggttcgtgtgaccctcttcttcat

SEQ ID NO: 107710 - DNA, 25 bp, mus musculus
aggcagcccactttggcctctggag

SEQ ID NO: 107711 - DNA, 25 bp, mus musculus
cagcccactttggcctctggaggat

SEQ ID NO: 107712 - DNA, 25 bp, mus musculus
cccactttggcctctggaggatctg

SEQ ID NO: 107713 - DNA, 25 bp, mus musculus
ggatctgcaccgctcgggttgccgt

SEQ ID NO: 107714 - DNA, 25 bp, mus musculus
gggttgccgtgcacaacaaagacaa

SEQ ID NO: 107715 - DNA, 25 bp, mus musculus
gttgtgagcacgtcacaccatcagg

SEQ ID NO: 107716 - DNA, 25 bp, mus musculus
agcacgtcacaccatcaggggaaaa

SEQ ID NO: 107717 - DNA, 25 bp, mus musculus
tcacaccatcaggggaaaagaactg

SEQ ID NO: 107718 - DNA, 25 bp, mus musculus
agaactgctcctacttcaggcactt

SEQ ID NO: 107719 - DNA, 25 bp, mus musculus
actgctcctacttcaggcacttcaa

SEQ ID NO: 107720 - DNA, 25 bp, mus musculus
ttcgtgtgaccctcttcttcatcct

SEQ ID NO: 107721 - DNA, 25 bp, mus musculus
tggtgactgaccactgggccgtgct

SEQ ID NO: 107722 - DNA, 25 bp, mus musculus
ctgaccactgggccgtgctgagtcc

SEQ ID NO: 107723 - DNA, 25 bp, mus musculus
ccgtgctgagtccacacctggagca

SEQ ID NO: 107724 - DNA, 25 bp, mus musculus
tgagtccacacctggagcaccacaa

SEQ ID NO: 107725 - DNA, 25 bp, mus musculus
cacacctggagcaccacaatgaaac

SEQ ID NO: 107726 - DNA, 25 bp, mus musculus
agcaccacaatgaaacgtgcgaggc

SEQ ID NO: 107727 - DNA, 25 bp, mus musculus
aaacgtgcgaggcagcccactttgg

SEQ ID NO: 107728 - DNA, 25 bp, mus musculus
tatccagtgaccacttcctgttcac

SEQ ID NO: 107729 - DNA, 25 bp, mus musculus
ccagtgaccacttcctgttcacttt

SEQ ID NO: 107730 - DNA, 25 bp, mus musculus
tcctactgcactggggacttttaga

SEQ ID NO: 107731 - DNA, 25 bp, mus musculus
tactgcactggggacttttagatag

SEQ ID NO: 107732 - DNA, 25 bp, mus musculus
gcctttattctgttactggacacga

SEQ ID NO: 107733 - DNA, 25 bp, mus musculus
tactctattgtacctttacagtcgc

SEQ ID NO: 107734 - DNA, 25 bp, mus musculus
tctattgtacctttacagtcgcagc

SEQ ID NO: 107735 - DNA, 25 bp, mus musculus
attgtacctttacagtcgcagcact

SEQ ID NO: 107736 - DNA, 25 bp, mus musculus
cctttacagtcgcagcactaaaatg

SEQ ID NO: 107737 - DNA, 25 bp, mus musculus
ttacagtcgcagcactaaaatggaa

SEQ ID NO: 107738 - DNA, 25 bp, mus musculus
cagtcgcagcactaaaatggaagac

SEQ ID NO: 107739 - DNA, 25 bp, mus musculus
gttttgctactcctgtcagacaatg

SEQ ID NO: 107740 - DNA, 25 bp, mus musculus
ctgcatctcagcagttggatgttct

SEQ ID NO: 107741 - DNA, 25 bp, mus musculus
tgtttgctctgggggccaggaattg

SEQ ID NO: 107742 - DNA, 25 bp, mus musculus
ttgctctgggggccaggaattggat

SEQ ID NO: 107743 - DNA, 25 bp, mus musculus
agctaatgctagctatactgcaatg

SEQ ID NO: 107744 - DNA, 25 bp, mus musculus
tagctatactgcaatgttaggggaa

SEQ ID NO: 107745 - DNA, 25 bp, mus musculus
ctatactgcaatgttaggggaatga

SEQ ID NO: 107746 - DNA, 25 bp, mus musculus
atgaacgcgttttcctactgcactg

SEQ ID NO: 107747 - DNA, 25 bp, mus musculus
gcgttttcctactgcactggggact

SEQ ID NO: 107748 - DNA, 25 bp, mus musculus
gctgtgttcaatgtccttgaccaga

SEQ ID NO: 107749 - DNA, 25 bp, mus musculus
ttcaatgtccttgaccagaatggtg

SEQ ID NO: 107750 - DNA, 25 bp, mus musculus
gtgcgcctccacgttgaaaattgag

SEQ ID NO: 107751 - DNA, 25 bp, mus musculus
cgcctccacgttgaaaattgagact

SEQ ID NO: 107752 - DNA, 25 bp, mus musculus
aattgagactgctggtcacaagctc

SEQ ID NO: 107753 - DNA, 25 bp, mus musculus
tggtcacaagctccaactcgtcgtc

SEQ ID NO: 107754 - DNA, 25 bp, mus musculus
tcacaagctccaactcgtcgtctat

SEQ ID NO: 107755 - DNA, 25 bp, mus musculus
caagctccaactcgtcgtctatctg

SEQ ID NO: 107756 - DNA, 25 bp, mus musculus
ccaactcgtcgtctatctgcctgtc

SEQ ID NO: 107757 - DNA, 25 bp, mus musculus
cgtctatctgcctgtctctgacaga

SEQ ID NO: 107758 - DNA, 25 bp, mus musculus
cttgcttgcggactctgcttttgtg

SEQ ID NO: 107759 - DNA, 25 bp, mus musculus
gcttgcggactctgcttttgtggtg

SEQ ID NO: 107760 - DNA, 25 bp, mus musculus
aatgtccttgaccagaatggtgatg

SEQ ID NO: 107761 - DNA, 25 bp, mus musculus
gtccttgaccagaatggtgatggct

SEQ ID NO: 107762 - DNA, 25 bp, mus musculus
gatggctacatcactgtggatgagc

SEQ ID NO: 107763 - DNA, 25 bp, mus musculus
tacatcactgtggatgagctcaagg

SEQ ID NO: 107764 - DNA, 25 bp, mus musculus
gaaagcttgtccaagttaggcgagt

SEQ ID NO: 107765 - DNA, 25 bp, mus musculus
gagtccctttcccaggaggagctgg

SEQ ID NO: 107766 - DNA, 25 bp, mus musculus
atgatccgtgtggctgacgtggacc

SEQ ID NO: 107767 - DNA, 25 bp, mus musculus
tttgtgcgcctccacgttgaaaatt

SEQ ID NO: 107768 - DNA, 25 bp, mus musculus
aattcacagggttctcaaggtgatc

SEQ ID NO: 107769 - DNA, 25 bp, mus musculus
gcttcccaagctgaagaagaacctt

SEQ ID NO: 107770 - DNA, 25 bp, mus musculus
aatggccacagacacagggagtctc

SEQ ID NO: 107771 - DNA, 25 bp, mus musculus
cacagacacagggagtctcgccacc

SEQ ID NO: 107772 - DNA, 25 bp, mus musculus
cgccaccgctctagggacatgggtc

SEQ ID NO: 107773 - DNA, 25 bp, mus musculus
cgctctagggacatgggtcgagacc

SEQ ID NO: 107774 - DNA, 25 bp, mus musculus
cgagaccaggaccacaatgagtgca

SEQ ID NO: 107775 - DNA, 25 bp, mus musculus
atcaaacaacgaagccggcataaat

SEQ ID NO: 107776 - DNA, 25 bp, mus musculus
gtatacatccgccaatgaccgtgcg

SEQ ID NO: 107777 - DNA, 25 bp, mus musculus
atccgccaatgaccgtgcgtgtccc

SEQ ID NO: 107778 - DNA, 25 bp, mus musculus
cccaagtctttgtgtatcatcctta

SEQ ID NO: 107779 - DNA, 25 bp, mus musculus
tgtatcatccttaagcaaaatcttt

SEQ ID NO: 107780 - DNA, 25 bp, mus musculus
ggcctctctaggcaagagacgtttg

SEQ ID NO: 107781 - DNA, 25 bp, mus musculus
gactctgaaacccaagagagccgag

SEQ ID NO: 107782 - DNA, 25 bp, mus musculus
gaaacccaagagagccgagactctg

SEQ ID NO: 107783 - DNA, 25 bp, mus musculus
agccgagactctgcctacgtggagc

SEQ ID NO: 107784 - DNA, 25 bp, mus musculus
gactctgcctacgtggagccaaagg

SEQ ID NO: 107785 - DNA, 25 bp, mus musculus
tattcacatgaacatgtggaccggt

SEQ ID NO: 107786 - DNA, 25 bp, mus musculus
acccacagcagcaatggccacagac

SEQ ID NO: 107787 - DNA, 25 bp, mus musculus
agcagcaatggccacagacacaggg

SEQ ID NO: 107788 - DNA, 25 bp, mus musculus
tgactctgtatctatgcaaagagct

SEQ ID NO: 107789 - DNA, 25 bp, mus musculus
tatgcaaagagctctttgtggtcct

SEQ ID NO: 107790 - DNA, 25 bp, mus musculus
ccttcaaagcctctcacatctaggc

SEQ ID NO: 107791 - DNA, 25 bp, mus musculus
tcaaagcctctcacatctaggccaa

SEQ ID NO: 107792 - DNA, 25 bp, mus musculus
aagcctctcacatctaggccaaagc

SEQ ID NO: 107793 - DNA, 25 bp, mus musculus
ctcacatctaggccaaagccccatg

SEQ ID NO: 107794 - DNA, 25 bp, mus musculus
acatctaggccaaagccccatgtgc

SEQ ID NO: 107795 - DNA, 25 bp, mus musculus
tctaggccaaagccccatgtgcctt

SEQ ID NO: 107796 - DNA, 25 bp, mus musculus
aggccaaagccccatgtgccttgtc

SEQ ID NO: 107797 - DNA, 25 bp, mus musculus
ccaaagccccatgtgccttgtccag

SEQ ID NO: 107798 - DNA, 25 bp, mus musculus
aagccccatgtgccttgtccaggaa

SEQ ID NO: 107799 - DNA, 25 bp, mus musculus
ccccatgtgccttgtccaggaaccg

SEQ ID NO: 107800 - DNA, 25 bp, mus musculus
gctaggcaggcctctctttctcagt

SEQ ID NO: 107801 - DNA, 25 bp, mus musculus
cttggcaatcagcatttctggtctg

SEQ ID NO: 107802 - DNA, 25 bp, mus musculus
ggcaatcagcatttctggtctgcta

SEQ ID NO: 107803 - DNA, 25 bp, mus musculus
cagcatttctggtctgctaaatata

SEQ ID NO: 107804 - DNA, 25 bp, mus musculus
tatatacgctgtgctgtgggttctt

SEQ ID NO: 107805 - DNA, 25 bp, mus musculus
aacggactcctgtgccccagagata

SEQ ID NO: 107806 - DNA, 25 bp, mus musculus
cccagagataccttcctatcccagg

SEQ ID NO: 107807 - DNA, 25 bp, mus musculus
gaggccccttcaaagcctctcacat

SEQ ID NO: 107808 - DNA, 25 bp, mus musculus
tgtgttgcttctttctctcctaaag

SEQ ID NO: 107809 - DNA, 25 bp, mus musculus
ttctctcctaaagcaaacctctgcc

SEQ ID NO: 107810 - DNA, 25 bp, mus musculus
ggcccaagagatgccactggggact

SEQ ID NO: 107811 - DNA, 25 bp, mus musculus
ttctcaccctggtgtcacatgctgt

SEQ ID NO: 107812 - DNA, 25 bp, mus musculus
ccctggtgtcacatgctgtgccttt

SEQ ID NO: 107813 - DNA, 25 bp, mus musculus
tgtcacatgctgtgcctttctcttt

SEQ ID NO: 107814 - DNA, 25 bp, mus musculus
gctgttccagacctgtgatactgtg

SEQ ID NO: 107815 - DNA, 25 bp, mus musculus
atatcccatgtgtacaaatgtgttt

SEQ ID NO: 107816 - DNA, 25 bp, mus musculus
ctctgaccttggcattcagaacaga

SEQ ID NO: 107817 - DNA, 25 bp, mus musculus
cattcagaacagacatctgtatttt

SEQ ID NO: 107818 - DNA, 25 bp, mus musculus
acatctgtatttttgcctttgaaat

SEQ ID NO: 107819 - DNA, 25 bp, mus musculus
gtatttttgcctttgaaatgcagta

SEQ ID NO: 107820 - DNA, 25 bp, mus musculus
gcaaacctctgccttttctctatgc

SEQ ID NO: 107821 - DNA, 25 bp, mus musculus
ctctgccttttctctatgctgttcg

SEQ ID NO: 107822 - DNA, 25 bp, mus musculus
tacgtggttcattctcaggaccata

SEQ ID NO: 107823 - DNA, 25 bp, mus musculus
gttcattctcaggaccatagggaaa

SEQ ID NO: 107824 - DNA, 25 bp, mus musculus
ctaaggcaccgttaggcttggcatt

SEQ ID NO: 107825 - DNA, 25 bp, mus musculus
caccgttaggcttggcattagcctg

SEQ ID NO: 107826 - DNA, 25 bp, mus musculus
taggcttggcattagcctggcccaa

SEQ ID NO: 107827 - DNA, 25 bp, mus musculus
tggcattagcctggcccaagagatg

SEQ ID NO: 107828 - DNA, 25 bp, mus musculus
acagtaatcttccgaagcataaaag

SEQ ID NO: 107829 - DNA, 25 bp, mus musculus
cagtaatcttccgaagcataaaaga

SEQ ID NO: 107830 - DNA, 25 bp, mus musculus
aacacagtactcttcgaaagcataa

SEQ ID NO: 107831 - DNA, 25 bp, mus musculus
acacagtactcttcgaaagcataag

SEQ ID NO: 107832 - DNA, 25 bp, mus musculus
gtactcttcgaaagcataagagaac

SEQ ID NO: 107833 - DNA, 25 bp, mus musculus
ttcggaacccagcagtctccaaatg

SEQ ID NO: 107834 - DNA, 25 bp, mus musculus
tcggaacccagcagtctccaaatgc

SEQ ID NO: 107835 - DNA, 25 bp, mus musculus
cggaacccagcagtctccaaatgca

SEQ ID NO: 107836 - DNA, 25 bp, mus musculus
ggaacccagcagtctccaaatgcat

SEQ ID NO: 107837 - DNA, 25 bp, mus musculus
gaacccagcagtctccaaatgcata

SEQ ID NO: 107838 - DNA, 25 bp, mus musculus
acagtaatcttccgaagcataaaag

SEQ ID NO: 107839 - DNA, 25 bp, mus musculus
cagtaatcttccgaagcataaaaga

SEQ ID NO: 107840 - DNA, 25 bp, mus musculus
gaacccagcagtctccaaatgcata

SEQ ID NO: 107841 - DNA, 25 bp, mus musculus
aacacagtactcttcgaaagcataa

SEQ ID NO: 107842 - DNA, 25 bp, mus musculus
acacagtactcttcgaaagcataag

SEQ ID NO: 107843 - DNA, 25 bp, mus musculus
gtactcttcgaaagcataagagaac

SEQ ID NO: 107844 - DNA, 25 bp, mus musculus
tttcggaacccagcagtctccaaat

SEQ ID NO: 107845 - DNA, 25 bp, mus musculus
ttcggaacccagcagtctccaaatg

SEQ ID NO: 107846 - DNA, 25 bp, mus musculus
tcggaacccagcagtctccaaatgc

SEQ ID NO: 107847 - DNA, 25 bp, mus musculus
cggaacccagcagtctccaaatgca

SEQ ID NO: 107848 - DNA, 25 bp, mus musculus
ggaacccagcagtctccaaatgcat

SEQ ID NO: 107849 - DNA, 25 bp, mus musculus
acagtaatcttccgaagcataaaag

SEQ ID NO: 107850 - DNA, 25 bp, mus musculus
cagtaatcttccgaagcataaaaga

SEQ ID NO: 107851 - DNA, 25 bp, mus musculus
gaacccagcagtctccaaatgcata

SEQ ID NO: 107852 - DNA, 25 bp, mus musculus
aacacagtactcttcgaaagcataa

SEQ ID NO: 107853 - DNA, 25 bp, mus musculus
acacagtactcttcgaaagcataag

SEQ ID NO: 107854 - DNA, 25 bp, mus musculus
gtactcttcgaaagcataagagaac

SEQ ID NO: 107855 - DNA, 25 bp, mus musculus
tttcggaacccagcagtctccaaat

SEQ ID NO: 107856 - DNA, 25 bp, mus musculus
ttcggaacccagcagtctccaaatg

SEQ ID NO: 107857 - DNA, 25 bp, mus musculus
tcggaacccagcagtctccaaatgc

SEQ ID NO: 107858 - DNA, 25 bp, mus musculus
cggaacccagcagtctccaaatgca

SEQ ID NO: 107859 - DNA, 25 bp, mus musculus
ggaacccagcagtctccaaatgcat

SEQ ID NO: 107860 - DNA, 25 bp, mus musculus
aggactgctgcgcttcggggcccag

SEQ ID NO: 107861 - DNA, 25 bp, mus musculus
ggtttcgacagactcttcaaaatgc

SEQ ID NO: 107862 - DNA, 25 bp, mus musculus
gatcctctggctgtggacaaaataa

SEQ ID NO: 107863 - DNA, 25 bp, mus musculus
atgaaggacctggaccagtgccgag

SEQ ID NO: 107864 - DNA, 25 bp, mus musculus
gggctcaccattgcatgcaatgact

SEQ ID NO: 107865 - DNA, 25 bp, mus musculus
caccacggggtcacttgaggaatct

SEQ ID NO: 107866 - DNA, 25 bp, mus musculus
gagcagatcaggacccttaggaaat

SEQ ID NO: 107867 - DNA, 25 bp, mus musculus
atcaggacccttaggaaatgtgcaa

SEQ ID NO: 107868 - DNA, 25 bp, mus musculus
aatgagatccaactccaattcaaca

SEQ ID NO: 107869 - DNA, 25 bp, mus musculus
atccaactccaattcaacaatctga

SEQ ID NO: 107870 - DNA, 25 bp, mus musculus
gtttgcatcccattgccctcaataa

SEQ ID NO: 107871 - DNA, 25 bp, mus musculus
atcccattgccctcaataaagaaag

SEQ ID NO: 107872 - DNA, 25 bp, mus musculus
gacagactcttcaaaatgccatccc

SEQ ID NO: 107873 - DNA, 25 bp, mus musculus
ctcttcaaaatgccatcccaaatgg

SEQ ID NO: 107874 - DNA, 25 bp, mus musculus
ccatcccaaatggagcacgccatgg

SEQ ID NO: 107875 - DNA, 25 bp, mus musculus
gagcacgccatggaaaccatgatgc

SEQ ID NO: 107876 - DNA, 25 bp, mus musculus
atgatgcttacgtttcacaggtttg

SEQ ID NO: 107877 - DNA, 25 bp, mus musculus
cttacgtttcacaggtttgcaggcg

SEQ ID NO: 107878 - DNA, 25 bp, mus musculus
tttcacaggtttgcaggcgacaaag

SEQ ID NO: 107879 - DNA, 25 bp, mus musculus
gacaaagaccacttgacaaaggagg

SEQ ID NO: 107880 - DNA, 25 bp, mus musculus
acacatcttgaactagacctcggag

SEQ ID NO: 107881 - DNA, 25 bp, mus musculus
catcttgaactagacctcggagagg

SEQ ID NO: 107882 - DNA, 25 bp, mus musculus
aggtttctccaggctgttagagtgt

SEQ ID NO: 107883 - DNA, 25 bp, mus musculus
agagtgtcagcacttcagcaggtca

SEQ ID NO: 107884 - DNA, 25 bp, mus musculus
cttcagcaggtcaagcacaaacctc

SEQ ID NO: 107885 - DNA, 25 bp, mus musculus
aagcacaaacctctgacagcttttg

SEQ ID NO: 107886 - DNA, 25 bp, mus musculus
gacaggcagctgactaggagggcat

SEQ ID NO: 107887 - DNA, 25 bp, mus musculus
agggcatcatctgacgagggtgatt

SEQ ID NO: 107888 - DNA, 25 bp, mus musculus
tcatctgacgagggtgattcttttc

SEQ ID NO: 107889 - DNA, 25 bp, mus musculus
cctgttgacttccattcacagtgtt

SEQ ID NO: 107890 - DNA, 25 bp, mus musculus
gttgacttccattcacagtgtttat

SEQ ID NO: 107891 - DNA, 25 bp, mus musculus
gacttccattcacagtgtttatgct

SEQ ID NO: 107892 - DNA, 25 bp, mus musculus
tagcatgattttcttcttagaataa

SEQ ID NO: 107893 - DNA, 25 bp, mus musculus
ataatttgttctgacgcgtcagtca

SEQ ID NO: 107894 - DNA, 25 bp, mus musculus
tgttctgacgcgtcagtcacactgg

SEQ ID NO: 107895 - DNA, 25 bp, mus musculus
gacgcgtcagtcacactggaactga

SEQ ID NO: 107896 - DNA, 25 bp, mus musculus
tcagtcacactggaactgacgttct

SEQ ID NO: 107897 - DNA, 25 bp, mus musculus
gtcacactggaactgacgttctatc

SEQ ID NO: 107898 - DNA, 25 bp, mus musculus
ctgacgttctatcagaggtttctcc

SEQ ID NO: 107899 - DNA, 25 bp, mus musculus
cagaggtttctccaggctgttagag

SEQ ID NO: 107900 - DNA, 25 bp, mus musculus
cgcccgcaacgcgagcatgaacaac

SEQ ID NO: 107901 - DNA, 25 bp, mus musculus
cccgcaacgcgagcatgaacaacgc

SEQ ID NO: 107902 - DNA, 25 bp, mus musculus
aagacaatggcaggctcggcgttgg

SEQ ID NO: 107903 - DNA, 25 bp, mus musculus
agacaatggcaggctcggcgttggc

SEQ ID NO: 107904 - DNA, 25 bp, mus musculus
acaatggcaggctcggcgttggcag

SEQ ID NO: 107905 - DNA, 25 bp, mus musculus
caatggcaggctcggcgttggcagt

SEQ ID NO: 107906 - DNA, 25 bp, mus musculus
gatacgggcgctggctccatctgag

SEQ ID NO: 107907 - DNA, 25 bp, mus musculus
gctgccctgaggaaacaccatgaag

SEQ ID NO: 107908 - DNA, 25 bp, mus musculus
atgagattgaccaccattcgaagga

SEQ ID NO: 107909 - DNA, 25 bp, mus musculus
gagattgaccaccattcgaaggaga

SEQ ID NO: 107910 - DNA, 25 bp, mus musculus
agattgaccaccattcgaaggagat

SEQ ID NO: 107911 - DNA, 25 bp, mus musculus
attgaccaccattcgaaggagatag

SEQ ID NO: 107912 - DNA, 25 bp, mus musculus
ccgcaacgcgagcatgaacaacgcc

SEQ ID NO: 107913 - DNA, 25 bp, mus musculus
ttgaccaccattcgaaggagataga

SEQ ID NO: 107914 - DNA, 25 bp, mus musculus
cgagcatgaacaacgccgaagacaa

SEQ ID NO: 107915 - DNA, 25 bp, mus musculus
gcatgaacaacgccgaagacaatgg

SEQ ID NO: 107916 - DNA, 25 bp, mus musculus
catgaacaacgccgaagacaatggc

SEQ ID NO: 107917 - DNA, 25 bp, mus musculus
tgaacaacgccgaagacaatggcag

SEQ ID NO: 107918 - DNA, 25 bp, mus musculus
gaacaacgccgaagacaatggcagg

SEQ ID NO: 107919 - DNA, 25 bp, mus musculus
acaacgccgaagacaatggcaggct

SEQ ID NO: 107920 - DNA, 25 bp, mus musculus
acgccgaagacaatggcaggctcgg

SEQ ID NO: 107921 - DNA, 25 bp, mus musculus
tagtgcagcagagcttcgccatgtg

SEQ ID NO: 107922 - DNA, 25 bp, mus musculus
gtgcagcagagcttcgccatgtgat

SEQ ID NO: 107923 - DNA, 25 bp, mus musculus
cttatcttactgtcattgtccttaa

SEQ ID NO: 107924 - DNA, 25 bp, mus musculus
tatcttactgtcattgtccttaaac

SEQ ID NO: 107925 - DNA, 25 bp, mus musculus
tcttactgtcattgtccttaaacct

SEQ ID NO: 107926 - DNA, 25 bp, mus musculus
taacatgttgcatgtggcttactct

SEQ ID NO: 107927 - DNA, 25 bp, mus musculus
gttgcatgtggcttactctggctat

SEQ ID NO: 107928 - DNA, 25 bp, mus musculus
catgtggcttactctggctatatct

SEQ ID NO: 107929 - DNA, 25 bp, mus musculus
tgtggcttactctggctatatctaa

SEQ ID NO: 107930 - DNA, 25 bp, mus musculus
tggcttactctggctatatctaagc

SEQ ID NO: 107931 - DNA, 25 bp, mus musculus
gcttactctggctatatctaagccc

SEQ ID NO: 107932 - DNA, 25 bp, mus musculus
ttactctggctatatctaagcccgt

SEQ ID NO: 107933 - DNA, 25 bp, mus musculus
gcagcagagcttcgccatgtgatga

SEQ ID NO: 107934 - DNA, 25 bp, mus musculus
ctggctatatctaagcccgtctgca

SEQ ID NO: 107935 - DNA, 25 bp, mus musculus
agcagagcttcgccatgtgatgaca

SEQ ID NO: 107936 - DNA, 25 bp, mus musculus
cagagcttcgccatgtgatgacaaa

SEQ ID NO: 107937 - DNA, 25 bp, mus musculus
gagcttcgccatgtgatgacaaacc

SEQ ID NO: 107938 - DNA, 25 bp, mus musculus
gcttcgccatgtgatgacaaacctt

SEQ ID NO: 107939 - DNA, 25 bp, mus musculus
aattaggacttcattcctccatgtt

SEQ ID NO: 107940 - DNA, 25 bp, mus musculus
ttcccttatcttactgtcattgtcc

SEQ ID NO: 107941 - DNA, 25 bp, mus musculus
cccttatcttactgtcattgtcctt

SEQ ID NO: 107942 - DNA, 25 bp, mus musculus
tatctctaaagtattctccatgttg

SEQ ID NO: 107943 - DNA, 25 bp, mus musculus
atctctaaagtattctccatgttgt

SEQ ID NO: 107944 - DNA, 25 bp, mus musculus
ttctccatgttgtgtcagactctga

SEQ ID NO: 107945 - DNA, 25 bp, mus musculus
atgttgtgtcagactctgatccatc

SEQ ID NO: 107946 - DNA, 25 bp, mus musculus
tgtgtcagactctgatccatcactt

SEQ ID NO: 107947 - DNA, 25 bp, mus musculus
gtgtcagactctgatccatcacttc

SEQ ID NO: 107948 - DNA, 25 bp, mus musculus
tgtcagactctgatccatcacttca

SEQ ID NO: 107949 - DNA, 25 bp, mus musculus
tcagactctgatccatcacttcaag

SEQ ID NO: 107950 - DNA, 25 bp, mus musculus
cagactctgatccatcacttcaagg

SEQ ID NO: 107951 - DNA, 25 bp, mus musculus
agactctgatccatcacttcaagga

SEQ ID NO: 107952 - DNA, 25 bp, mus musculus
actctgatccatcacttcaaggatg

SEQ ID NO: 107953 - DNA, 25 bp, mus musculus
tctgatccatcacttcaaggatgcg

SEQ ID NO: 107954 - DNA, 25 bp, mus musculus
ctctaaagtattctccatgttgtgt

SEQ ID NO: 107955 - DNA, 25 bp, mus musculus
tctaaagtattctccatgttgtgtc

SEQ ID NO: 107956 - DNA, 25 bp, mus musculus
ctaaagtattctccatgttgtgtca

SEQ ID NO: 107957 - DNA, 25 bp, mus musculus
aaagtattctccatgttgtgtcaga

SEQ ID NO: 107958 - DNA, 25 bp, mus musculus
aagtattctccatgttgtgtcagac

SEQ ID NO: 107959 - DNA, 25 bp, mus musculus
agtattctccatgttgtgtcagact

SEQ ID NO: 107960 - DNA, 25 bp, mus musculus
tattctccatgttgtgtcagactct

SEQ ID NO: 107961 - DNA, 25 bp, mus musculus
attctccatgttgtgtcagactctg

SEQ ID NO: 107962 - DNA, 25 bp, mus musculus
gttccagccttcgccatgggattcg

SEQ ID NO: 107963 - DNA, 25 bp, mus musculus
cagccttcgccatgggattcggaga

SEQ ID NO: 107964 - DNA, 25 bp, mus musculus
aaaggccagcctgccgggagtgaag

SEQ ID NO: 107965 - DNA, 25 bp, mus musculus
aaggccagcctgccgggagtgaaga

SEQ ID NO: 107966 - DNA, 25 bp, mus musculus
gccagcctgccgggagtgaagaaat

SEQ ID NO: 107967 - DNA, 25 bp, mus musculus
ccagcctgccgggagtgaagaaatc

SEQ ID NO: 107968 - DNA, 25 bp, mus musculus
cagcctgccgggagtgaagaaatct

SEQ ID NO: 107969 - DNA, 25 bp, mus musculus
agcctgccgggagtgaagaaatctt

SEQ ID NO: 107970 - DNA, 25 bp, mus musculus
ggtacgtgccatcacaagcagacgt

SEQ ID NO: 107971 - DNA, 25 bp, mus musculus
gtacgtgccatcacaagcagacgtg

SEQ ID NO: 107972 - DNA, 25 bp, mus musculus
tacgtgccatcacaagcagacgtgg

SEQ ID NO: 107973 - DNA, 25 bp, mus musculus
acgtgccatcacaagcagacgtggc

SEQ ID NO: 107974 - DNA, 25 bp, mus musculus
cgtgccatcacaagcagacgtggca

SEQ ID NO: 107975 - DNA, 25 bp, mus musculus
gtgccatcacaagcagacgtggcag

SEQ ID NO: 107976 - DNA, 25 bp, mus musculus
tgccatcacaagcagacgtggcagt

SEQ ID NO: 107977 - DNA, 25 bp, mus musculus
caccacctgctgacctgtgtcatgc

SEQ ID NO: 107978 - DNA, 25 bp, mus musculus
catctgaactcaatcaaggcttata

SEQ ID NO: 107979 - DNA, 25 bp, mus musculus
aactcaatcaaggcttatatcactt

SEQ ID NO: 107980 - DNA, 25 bp, mus musculus
tccacaatttacaagacttcaggct

SEQ ID NO: 107981 - DNA, 25 bp, mus musculus
tatgacctgggcatcaaacacacat

SEQ ID NO: 107982 - DNA, 25 bp, mus musculus
ctgggcatcaaacacacatttgcct

SEQ ID NO: 107983 - DNA, 25 bp, mus musculus
cacacatttgcctttgagcttcgtg

SEQ ID NO: 107984 - DNA, 25 bp, mus musculus
tttattgccaagtatatcctcaaga

SEQ ID NO: 107985 - DNA, 25 bp, mus musculus
ctcaagaatacttcctaatgaattg

SEQ ID NO: 107986 - DNA, 25 bp, mus musculus
tggaaagacaacctcctacatcacc

SEQ ID NO: 107987 - DNA, 25 bp, mus musculus
catcacctggattcatccttctctt

SEQ ID NO: 107988 - DNA, 25 bp, mus musculus
tcatccttctcttgctcatgaagtc

SEQ ID NO: 107989 - DNA, 25 bp, mus musculus
ttctcttgctcatgaagtcctgcat

SEQ ID NO: 107990 - DNA, 25 bp, mus musculus
gcttatatcactttccattcctact

SEQ ID NO: 107991 - DNA, 25 bp, mus musculus
ttccattcctactcgcagatgctat

SEQ ID NO: 107992 - DNA, 25 bp, mus musculus
atgctattaattccttatggctaca

SEQ ID NO: 107993 - DNA, 25 bp, mus musculus
ccttatggctacacattcaaactgc

SEQ ID NO: 107994 - DNA, 25 bp, mus musculus
ggctacacattcaaactgcctccta

SEQ ID NO: 107995 - DNA, 25 bp, mus musculus
gctctctcaactagatatgaaaccc

SEQ ID NO: 107996 - DNA, 25 bp, mus musculus
cgttacatctacggcccaatagcat

SEQ ID NO: 107997 - DNA, 25 bp, mus musculus
ggcccaatagcatccacaatttaca

SEQ ID NO: 107998 - DNA, 25 bp, mus musculus
caagaataacctggcttcctgctac

SEQ ID NO: 107999 - DNA, 25 bp, mus musculus
gaataacctggcttcctgctaccta

SEQ ID NO: 108000 - DNA, 25 bp, mus musculus
caagccgatctggatgcatgctgag

SEQ ID NO: 108001 - DNA, 25 bp, mus musculus
gccgatctggatgcatgctgaggaa

SEQ ID NO: 108002 - DNA, 25 bp, mus musculus
gccccgtgacagcagtgcgccctat

SEQ ID NO: 108003 - DNA, 25 bp, mus musculus
cagcagtgcgccctatgcagagtac

SEQ ID NO: 108004 - DNA, 25 bp, mus musculus
cagtgcgccctatgcagagtacgga

SEQ ID NO: 108005 - DNA, 25 bp, mus musculus
gtacaaggcctgctcatctgctgaa

SEQ ID NO: 108006 - DNA, 25 bp, mus musculus
tgctgaacgatgctctcagcatccg

SEQ ID NO: 108007 - DNA, 25 bp, mus musculus
tgaacgatgctctcagcatccggga

SEQ ID NO: 108008 - DNA, 25 bp, mus musculus
acgatgctctcagcatccgggagag

SEQ ID NO: 108009 - DNA, 25 bp, mus musculus
atgctctcagcatccgggagagcac

SEQ ID NO: 108010 - DNA, 25 bp, mus musculus
cctggcttcctgctacctaaagcag

SEQ ID NO: 108011 - DNA, 25 bp, mus musculus
ctacctaaagcagggcaagtactct

SEQ ID NO: 108012 - DNA, 25 bp, mus musculus
caagtactctgaggccgaggctctg

SEQ ID NO: 108013 - DNA, 25 bp, mus musculus
caaagagatcctgacctgtgcccat

SEQ ID NO: 108014 - DNA, 25 bp, mus musculus
gatcctgacctgtgcccatgtgcag

SEQ ID NO: 108015 - DNA, 25 bp, mus musculus
gacctgtgcccatgtgcaggagttc

SEQ ID NO: 108016 - DNA, 25 bp, mus musculus
tgatgaccacaagccgatctggatg

SEQ ID NO: 108017 - DNA, 25 bp, mus musculus
ccacaagccgatctggatgcatgct

SEQ ID NO: 108018 - DNA, 25 bp, mus musculus
cactacaggccatctttgcctgcta

SEQ ID NO: 108019 - DNA, 25 bp, mus musculus
aggccatctttgcctgctactgcta

SEQ ID NO: 108020 - DNA, 25 bp, mus musculus
aatactgtggccaatcctgaagctt

SEQ ID NO: 108021 - DNA, 25 bp, mus musculus
aatcctgaagcttccacagtgtcta

SEQ ID NO: 108022 - DNA, 25 bp, mus musculus
gtgtctatcaatacccctgagacta

SEQ ID NO: 108023 - DNA, 25 bp, mus musculus
atcaatacccctgagactactacag

SEQ ID NO: 108024 - DNA, 25 bp, mus musculus
gagactactacagtcccagtgtcct

SEQ ID NO: 108025 - DNA, 25 bp, mus musculus
gtcccagtgtcctcaactgcagcat

SEQ ID NO: 108026 - DNA, 25 bp, mus musculus
gtgtcctcaactgcagcataaaaca

SEQ ID NO: 108027 - DNA, 25 bp, mus musculus
tcaactgcagcataaaacactaagg

SEQ ID NO: 108028 - DNA, 25 bp, mus musculus
ggaaactctgccatcattcaagaga

SEQ ID NO: 108029 - DNA, 25 bp, mus musculus
tctgccatcattcaagagaaaatgc

SEQ ID NO: 108030 - DNA, 25 bp, mus musculus
tctttgcctgctactgctagcccat

SEQ ID NO: 108031 - DNA, 25 bp, mus musculus
cctgctactgctagcccatacatgt

SEQ ID NO: 108032 - DNA, 25 bp, mus musculus
agcccatacatgtactacccacttg

SEQ ID NO: 108033 - DNA, 25 bp, mus musculus
atctccaaatggcaatcaatgccaa

SEQ ID NO: 108034 - DNA, 25 bp, mus musculus
atgccaaatttcccccagtctgctg

SEQ ID NO: 108035 - DNA, 25 bp, mus musculus
ccatcctttcttgccatgcctacaa

SEQ ID NO: 108036 - DNA, 25 bp, mus musculus
gccatgcctacaaatgaaaatcagg

SEQ ID NO: 108037 - DNA, 25 bp, mus musculus
attactcccattgtgtccacaccag

SEQ ID NO: 108038 - DNA, 25 bp, mus musculus
catgcttttgatgccgtttcctgaa

SEQ ID NO: 108039 - DNA, 25 bp, mus musculus
gcttttgatgccgtttcctgaaggg

SEQ ID NO: 108040 - DNA, 25 bp, mus musculus
cacacacacatgcaatacacacact

SEQ ID NO: 108041 - DNA, 25 bp, mus musculus
acacacatgcaatacacacactaca

SEQ ID NO: 108042 - DNA, 25 bp, mus musculus
atgcaatacacacactacacacaca

SEQ ID NO: 108043 - DNA, 25 bp, mus musculus
tataagcaaaaccatacttgcatca

SEQ ID NO: 108044 - DNA, 25 bp, mus musculus
aaccatacttgcatcatgtcttcca

SEQ ID NO: 108045 - DNA, 25 bp, mus musculus
catacttgcatcatgtcttccaaaa

SEQ ID NO: 108046 - DNA, 25 bp, mus musculus
tgcatcatgtcttccaaaagtaact

SEQ ID NO: 108047 - DNA, 25 bp, mus musculus
acttaatgtttattcctgtgctgtg

SEQ ID NO: 108048 - DNA, 25 bp, mus musculus
taatgtttattcctgtgctgtgcgg

SEQ ID NO: 108049 - DNA, 25 bp, mus musculus
taatacgcagtgatttcacatagga

SEQ ID NO: 108050 - DNA, 25 bp, mus musculus
gatgccgtttcctgaagggaaatga

SEQ ID NO: 108051 - DNA, 25 bp, mus musculus
tctaataggacttctgtttggatta

SEQ ID NO: 108052 - DNA, 25 bp, mus musculus
atagtgtattctcctattacctcat

SEQ ID NO: 108053 - DNA, 25 bp, mus musculus
gtgtattctcctattacctcatggt

SEQ ID NO: 108054 - DNA, 25 bp, mus musculus
tattctcctattacctcatggtctg

SEQ ID NO: 108055 - DNA, 25 bp, mus musculus
attacctcatggtctggtatatata

SEQ ID NO: 108056 - DNA, 25 bp, mus musculus
acctcatggtctggtatatatacaa

SEQ ID NO: 108057 - DNA, 25 bp, mus musculus
acacacacacacatgcaatacacac

SEQ ID NO: 108058 - DNA, 25 bp, mus musculus
acaacgcaacgtggagacgcaacag

SEQ ID NO: 108059 - DNA, 25 bp, mus musculus
cagtgacaatgaccgcctgcgcaag

SEQ ID NO: 108060 - DNA, 25 bp, mus musculus
tggatctctaggctgcccgggccgc

SEQ ID NO: 108061 - DNA, 25 bp, mus musculus
atctctaggctgcccgggccgcgca

SEQ ID NO: 108062 - DNA, 25 bp, mus musculus
cgcaagccaggactaggagattccg

SEQ ID NO: 108063 - DNA, 25 bp, mus musculus
ttcctctgagccggactcggtgcgt

SEQ ID NO: 108064 - DNA, 25 bp, mus musculus
gccggactcggtgcgtctaagatga

SEQ ID NO: 108065 - DNA, 25 bp, mus musculus
tccttgagaccgagagacttttccg

SEQ ID NO: 108066 - DNA, 25 bp, mus musculus
ccgagagacttttccgcggagctga

SEQ ID NO: 108067 - DNA, 25 bp, mus musculus
agagacttttccgcggagctgagct

SEQ ID NO: 108068 - DNA, 25 bp, mus musculus
gacttttccgcggagctgagctggg

SEQ ID NO: 108069 - DNA, 25 bp, mus musculus
gaagtaaccttgtgccttggatact

SEQ ID NO: 108070 - DNA, 25 bp, mus musculus
tgacaatgaccgcctgcgcaagcgg

SEQ ID NO: 108071 - DNA, 25 bp, mus musculus
ccgtgaactggacacgctgcggggc

SEQ ID NO: 108072 - DNA, 25 bp, mus musculus
ccgccagctgcctgagagctccttg

SEQ ID NO: 108073 - DNA, 25 bp, mus musculus
ccagctgcctgagagctccttggtc

SEQ ID NO: 108074 - DNA, 25 bp, mus musculus
gctgcctgagagctccttggtcaag

SEQ ID NO: 108075 - DNA, 25 bp, mus musculus
tgagagctccttggtcaaggccatg

SEQ ID NO: 108076 - DNA, 25 bp, mus musculus
gagctccttggtcaaggccatggca

SEQ ID NO: 108077 - DNA, 25 bp, mus musculus
aggatggtttcgggtcgctggatct

SEQ ID NO: 108078 - DNA, 25 bp, mus musculus
tagctgaggcactgttctcaaaagg

SEQ ID NO: 108079 - DNA, 25 bp, mus musculus
tgttctcaaaaggctcaatgctagt

SEQ ID NO: 108080 - DNA, 25 bp, mus musculus
tgtcagcatgccagggcgtcgactc

SEQ ID NO: 108081 - DNA, 25 bp, mus musculus
cctgcatgtcctctctctactgtag

SEQ ID NO: 108082 - DNA, 25 bp, mus musculus
tgtcctctctctactgtagtgtcat

SEQ ID NO: 108083 - DNA, 25 bp, mus musculus
ctctctactgtagtgtcatttctca

SEQ ID NO: 108084 - DNA, 25 bp, mus musculus
gtgtcatttctcacaaggccgtcca

SEQ ID NO: 108085 - DNA, 25 bp, mus musculus
catcttgtactttcatcctcctaag

SEQ ID NO: 108086 - DNA, 25 bp, mus musculus
tcatcctcctaagctgttacataaa

SEQ ID NO: 108087 - DNA, 25 bp, mus musculus
gtatcttgtcctaccaggtcaagag

SEQ ID NO: 108088 - DNA, 25 bp, mus musculus
tccaccgctcaacatggtttcagat

SEQ ID NO: 108089 - DNA, 25 bp, mus musculus
cagaggccaccatgacaatgtagcc

SEQ ID NO: 108090 - DNA, 25 bp, mus musculus
tgctagtcttccagagttagggctc

SEQ ID NO: 108091 - DNA, 25 bp, mus musculus
tcttccagagttagggctccagaga

SEQ ID NO: 108092 - DNA, 25 bp, mus musculus
accaagctctgtggacaacagtggg

SEQ ID NO: 108093 - DNA, 25 bp, mus musculus
ctataactcgtacattcagaaggct

SEQ ID NO: 108094 - DNA, 25 bp, mus musculus
ctcgtacattcagaaggctgaggca

SEQ ID NO: 108095 - DNA, 25 bp, mus musculus
tgcaggccaacctgagctacagtta

SEQ ID NO: 108096 - DNA, 25 bp, mus musculus
ccaacctgagctacagttacagtgt

SEQ ID NO: 108097 - DNA, 25 bp, mus musculus
tacaagtgtcagcatgccagggcgt

SEQ ID NO: 108098 - DNA, 25 bp, mus musculus
catcctgattacaatccgcagaaca

SEQ ID NO: 108099 - DNA, 25 bp, mus musculus
gattacaatccgcagaacatccgga

SEQ ID NO: 108100 - DNA, 25 bp, mus musculus
tgtagcaatgtggcccagggcatcg

SEQ ID NO: 108101 - DNA, 25 bp, mus musculus
gtctcctatggaagcaacaatggta

SEQ ID NO: 108102 - DNA, 25 bp, mus musculus
ccagctgtattcaccaaaatccaga

SEQ ID NO: 108103 - DNA, 25 bp, mus musculus
agcttcatgccctggatcaaaagaa

SEQ ID NO: 108104 - DNA, 25 bp, mus musculus
agacgctttgcaccaagatatcaga

SEQ ID NO: 108105 - DNA, 25 bp, mus musculus
tttgcaccaagatatcagagacctg

SEQ ID NO: 108106 - DNA, 25 bp, mus musculus
tatcagagacctgctaactccctgt

SEQ ID NO: 108107 - DNA, 25 bp, mus musculus
gctaactccctgtctcaggcacaga

SEQ ID NO: 108108 - DNA, 25 bp, mus musculus
tctcaggcacagacctagggacttc

SEQ ID NO: 108109 - DNA, 25 bp, mus musculus
gcacagacctagggacttccatagc

SEQ ID NO: 108110 - DNA, 25 bp, mus musculus
cagaacatccggaatgacatcatgc

SEQ ID NO: 108111 - DNA, 25 bp, mus musculus
aaactgcagccaggggatttgtgca

SEQ ID NO: 108112 - DNA, 25 bp, mus musculus
gaccaaatgtgcgccaatcgcttcc

SEQ ID NO: 108113 - DNA, 25 bp, mus musculus
gccaatcgcttccagttctacaaca

SEQ ID NO: 108114 - DNA, 25 bp, mus musculus
cgcttccagttctacaacagccaga

SEQ ID NO: 108115 - DNA, 25 bp, mus musculus
cagttctacaacagccagactcaga

SEQ ID NO: 108116 - DNA, 25 bp, mus musculus
tacaacagccagactcagatctgtg

SEQ ID NO: 108117 - DNA, 25 bp, mus musculus
tctgccttcaggggtgattctggtg

SEQ ID NO: 108118 - DNA, 25 bp, mus musculus
ccatgaccgagctgctcaagtctgt

SEQ ID NO: 108119 - DNA, 25 bp, mus musculus
gaccgagctgctcaagtctgtggac

SEQ ID NO: 108120 - DNA, 25 bp, mus musculus
tctggttggctgggtgaagaacaca

SEQ ID NO: 108121 - DNA, 25 bp, mus musculus
acacaagcaaaggcacagtgacagg

SEQ ID NO: 108122 - DNA, 25 bp, mus musculus
atgccatgaagtcctggctgagcaa

SEQ ID NO: 108123 - DNA, 25 bp, mus musculus
gccatgaagtcctggctgagcaagg

SEQ ID NO: 108124 - DNA, 25 bp, mus musculus
catgaagtcctggctgagcaaggtt

SEQ ID NO: 108125 - DNA, 25 bp, mus musculus
cctggctgagcaaggttgggagtcc

SEQ ID NO: 108126 - DNA, 25 bp, mus musculus
ggagtcctagttctcgcatcgaccg

SEQ ID NO: 108127 - DNA, 25 bp, mus musculus
agtcctagttctcgcatcgaccggg

SEQ ID NO: 108128 - DNA, 25 bp, mus musculus
ctagttctcgcatcgaccgggccga

SEQ ID NO: 108129 - DNA, 25 bp, mus musculus
ttctcgcatcgaccgggccgacttt

SEQ ID NO: 108130 - DNA, 25 bp, mus musculus
ccgagctgctcaagtctgtggacta

SEQ ID NO: 108131 - DNA, 25 bp, mus musculus
gagctgctcaagtctgtggactacg

SEQ ID NO: 108132 - DNA, 25 bp, mus musculus
gctgctcaagtctgtggactacgaa

SEQ ID NO: 108133 - DNA, 25 bp, mus musculus
ctcaagtctgtggactacgaagtgt

SEQ ID NO: 108134 - DNA, 25 bp, mus musculus
caagtctgtggactacgaagtgttc

SEQ ID NO: 108135 - DNA, 25 bp, mus musculus
agtctgtggactacgaagtgttcgg

SEQ ID NO: 108136 - DNA, 25 bp, mus musculus
tggactacgaagtgttcgggacagt

SEQ ID NO: 108137 - DNA, 25 bp, mus musculus
tgttcgggacagtgcaaggtgtttg

SEQ ID NO: 108138 - DNA, 25 bp, mus musculus
ctgctggacatgctgcgccgcgaac

SEQ ID NO: 108139 - DNA, 25 bp, mus musculus
acatgctgcgccgcgaacactgaag

SEQ ID NO: 108140 - DNA, 25 bp, mus musculus
tggctgacgatcggggcatccagaa

SEQ ID NO: 108141 - DNA, 25 bp, mus musculus
ctgacgatcggggcatccagaaggg

SEQ ID NO: 108142 - DNA, 25 bp, mus musculus
tgacgatcggggcatccagaagggc

SEQ ID NO: 108143 - DNA, 25 bp, mus musculus
acgatcggggcatccagaagggcaa

SEQ ID NO: 108144 - DNA, 25 bp, mus musculus
cgatcggggcatccagaagggcaac

SEQ ID NO: 108145 - DNA, 25 bp, mus musculus
acctaccagatgctggcgcgcacgt

SEQ ID NO: 108146 - DNA, 25 bp, mus musculus
ctaccagatgctggcgcgcacgtgc

SEQ ID NO: 108147 - DNA, 25 bp, mus musculus
taccagatgctggcgcgcacgtgca

SEQ ID NO: 108148 - DNA, 25 bp, mus musculus
accagatgctggcgcgcacgtgcaa

SEQ ID NO: 108149 - DNA, 25 bp, mus musculus
cagatgctggcgcgcacgtgcaaac

SEQ ID NO: 108150 - DNA, 25 bp, mus musculus
catgctgcgccgcgaacactgaagg

SEQ ID NO: 108151 - DNA, 25 bp, mus musculus
tgctgcgccgcgaacactgaaggac

SEQ ID NO: 108152 - DNA, 25 bp, mus musculus
tccaagcacaaggcggtgctggctg

SEQ ID NO: 108153 - DNA, 25 bp, mus musculus
ccaagcacaaggcggtgctggctga

SEQ ID NO: 108154 - DNA, 25 bp, mus musculus
aagcacaaggcggtgctggctgacg

SEQ ID NO: 108155 - DNA, 25 bp, mus musculus
agcacaaggcggtgctggctgacga

SEQ ID NO: 108156 - DNA, 25 bp, mus musculus
gcacaaggcggtgctggctgacgat

SEQ ID NO: 108157 - DNA, 25 bp, mus musculus
gtgctggctgacgatcggggcatcc

SEQ ID NO: 108158 - DNA, 25 bp, mus musculus
tgctgccaccaaggcagcgcagcct

SEQ ID NO: 108159 - DNA, 25 bp, mus musculus
ggcagcgcagcctccaacggagact

SEQ ID NO: 108160 - DNA, 25 bp, mus musculus
tctctctgtgtggcaaacatttaaa

SEQ ID NO: 108161 - DNA, 25 bp, mus musculus
aagtccaacagtgtggcttaaacat

SEQ ID NO: 108162 - DNA, 25 bp, mus musculus
gcttaaacattgtttcttggtgttg

SEQ ID NO: 108163 - DNA, 25 bp, mus musculus
tgatgcagtcatcttgggaaattct

SEQ ID NO: 108164 - DNA, 25 bp, mus musculus
gcgtgtggccctgtgggagtccact

SEQ ID NO: 108165 - DNA, 25 bp, mus musculus
tgtggccctgtgggagtccactttc

SEQ ID NO: 108166 - DNA, 25 bp, mus musculus
ggagtccactttcctctctatttct

SEQ ID NO: 108167 - DNA, 25 bp, mus musculus
tgtgtgtgcaactgttccgttctga

SEQ ID NO: 108168 - DNA, 25 bp, mus musculus
tgcaactgttccgttctgaggagtc

SEQ ID NO: 108169 - DNA, 25 bp, mus musculus
tgttccgttctgaggagtccaaaat

SEQ ID NO: 108170 - DNA, 25 bp, mus musculus
agcgcagcctccaacggagactgca

SEQ ID NO: 108171 - DNA, 25 bp, mus musculus
tgcccgacaggatgagggtaaagaa

SEQ ID NO: 108172 - DNA, 25 bp, mus musculus
tgaccaagaacatgcctgaacttta

SEQ ID NO: 108173 - DNA, 25 bp, mus musculus
acatgcctgaactttaagaaatggc

SEQ ID NO: 108174 - DNA, 25 bp, mus musculus
cactctgaagtttccatctcctgtc

SEQ ID NO: 108175 - DNA, 25 bp, mus musculus
tgtgagcctgtcctctcctacctat

SEQ ID NO: 108176 - DNA, 25 bp, mus musculus
tgagccctctctctctgtgtggcaa

SEQ ID NO: 108177 - DNA, 25 bp, mus musculus
gccctctctctctgtgtggcaaaca

SEQ ID NO: 108178 - DNA, 25 bp, mus musculus
agtcagcatgcaggtctcagttctc

SEQ ID NO: 108179 - DNA, 25 bp, mus musculus
ctcagttctcatcaacgtctgcata

SEQ ID NO: 108180 - DNA, 25 bp, mus musculus
tgttctcgttgtaaacgttagaatg

SEQ ID NO: 108181 - DNA, 25 bp, mus musculus
ttttgctgtagtcatcaagggtgcc

SEQ ID NO: 108182 - DNA, 25 bp, mus musculus
cactccaggccccagtgtactgtgt

SEQ ID NO: 108183 - DNA, 25 bp, mus musculus
ccccagtgtactgtgtgtccagtat

SEQ ID NO: 108184 - DNA, 25 bp, mus musculus
cagtgtactgtgtgtccagtatagt

SEQ ID NO: 108185 - DNA, 25 bp, mus musculus
actgtgtgtccagtatagttaagga

SEQ ID NO: 108186 - DNA, 25 bp, mus musculus
ttaacatgtatcccacagttgtagt

SEQ ID NO: 108187 - DNA, 25 bp, mus musculus
aattgagccaccttgaacagtctga

SEQ ID NO: 108188 - DNA, 25 bp, mus musculus
tgagccaccttgaacagtctgattc

SEQ ID NO: 108189 - DNA, 25 bp, mus musculus
gccaccttgaacagtctgattcaga

SEQ ID NO: 108190 - DNA, 25 bp, mus musculus
tctcatcaacgtctgcatacaggga

SEQ ID NO: 108191 - DNA, 25 bp, mus musculus
catcaacgtctgcatacagggaaga

SEQ ID NO: 108192 - DNA, 25 bp, mus musculus
tgtggcaaagccctcaaccataatt

SEQ ID NO: 108193 - DNA, 25 bp, mus musculus
tggtgtagccactgtgggaaaacct

SEQ ID NO: 108194 - DNA, 25 bp, mus musculus
ttctgtagcaagtccaatctgtcca

SEQ ID NO: 108195 - DNA, 25 bp, mus musculus
tgtagcaagtccaatctgtccaagc

SEQ ID NO: 108196 - DNA, 25 bp, mus musculus
agcaagtccaatctgtccaagcatc

SEQ ID NO: 108197 - DNA, 25 bp, mus musculus
aatctgtccaagcatcagagagttc

SEQ ID NO: 108198 - DNA, 25 bp, mus musculus
acgagccttgaggcttcctcagaca

SEQ ID NO: 108199 - DNA, 25 bp, mus musculus
tcagacagccacctgcaagcagcac

SEQ ID NO: 108200 - DNA, 25 bp, mus musculus
ggatccctatgctgaccccaacaca

SEQ ID NO: 108201 - DNA, 25 bp, mus musculus
ctatgctgaccccaacacatgcaaa

SEQ ID NO: 108202 - DNA, 25 bp, mus musculus
gggccctctcattgttcacaagaga

SEQ ID NO: 108203 - DNA, 25 bp, mus musculus
aagccgcttcattcaagttggtgtg

SEQ ID NO: 108204 - DNA, 25 bp, mus musculus
cttcattcaagttggtgtgattagc

SEQ ID NO: 108205 - DNA, 25 bp, mus musculus
ctgcagagaccagaggcggcaacag

SEQ ID NO: 108206 - DNA, 25 bp, mus musculus
agaccagaggcggcaacagctggta

SEQ ID NO: 108207 - DNA, 25 bp, mus musculus
gcaacagctggtaccctcttatgcc

SEQ ID NO: 108208 - DNA, 25 bp, mus musculus
ttatgcccgggacttccacatcaac

SEQ ID NO: 108209 - DNA, 25 bp, mus musculus
gctgccctggctaaaggacaagctc

SEQ ID NO: 108210 - DNA, 25 bp, mus musculus
caaggaacagttgctccctgtgaag

SEQ ID NO: 108211 - DNA, 25 bp, mus musculus
caaagctctgtttgtatctgagcaa

SEQ ID NO: 108212 - DNA, 25 bp, mus musculus
tctgtttgtatctgagcaagggaag

SEQ ID NO: 108213 - DNA, 25 bp, mus musculus
gagcctgactcggaaggaggtgtac

SEQ ID NO: 108214 - DNA, 25 bp, mus musculus
agatgctacaaaggcccaaggctat

SEQ ID NO: 108215 - DNA, 25 bp, mus musculus
tacaaaggcccaaggctatgagaag

SEQ ID NO: 108216 - DNA, 25 bp, mus musculus
ggtcaaagatgcctctgaggtggtc

SEQ ID NO: 108217 - DNA, 25 bp, mus musculus
agatgcctctgaggtggtcactcca

SEQ ID NO: 108218 - DNA, 25 bp, mus musculus
tatccctagaagcagctagctactc

SEQ ID NO: 108219 - DNA, 25 bp, mus musculus
aagcagctagctactccaggtacgt

SEQ ID NO: 108220 - DNA, 25 bp, mus musculus
gctctgtacagggctacatggaaca

SEQ ID NO: 108221 - DNA, 25 bp, mus musculus
acatggaacaagcctccaagacggt

SEQ ID NO: 108222 - DNA, 25 bp, mus musculus
tggaacaagcctccaagacggtcca

SEQ ID NO: 108223 - DNA, 25 bp, mus musculus
cctccaagacggtccaggatgcgct

SEQ ID NO: 108224 - DNA, 25 bp, mus musculus
cgctaagtagcgtgcaggagtccga

SEQ ID NO: 108225 - DNA, 25 bp, mus musculus
tggacaatcacttcagatccctgaa

SEQ ID NO: 108226 - DNA, 25 bp, mus musculus
acaatcacttcagatccctgaaagg

SEQ ID NO: 108227 - DNA, 25 bp, mus musculus
atcacttcagatccctgaaaggcta

SEQ ID NO: 108228 - DNA, 25 bp, mus musculus
gatccctgaaaggctactggagcaa

SEQ ID NO: 108229 - DNA, 25 bp, mus musculus
ttactgacaagttcaccggcttctg

SEQ ID NO: 108230 - DNA, 25 bp, mus musculus
ctagctactccaggtacgtaggtgc

SEQ ID NO: 108231 - DNA, 25 bp, mus musculus
ctgacaagttcaccggcttctggga

SEQ ID NO: 108232 - DNA, 25 bp, mus musculus
gctactccaggtacgtaggtgccat

SEQ ID NO: 108233 - DNA, 25 bp, mus musculus
actccaggtacgtaggtgccatgca

SEQ ID NO: 108234 - DNA, 25 bp, mus musculus
taggtgccatgcagccccggacgct

SEQ ID NO: 108235 - DNA, 25 bp, mus musculus
tggcatctgcccgagctgaagaggt

SEQ ID NO: 108236 - DNA, 25 bp, mus musculus
catctgcccgagctgaagaggtaga

SEQ ID NO: 108237 - DNA, 25 bp, mus musculus
gatccttgctgctgggctctgtaca

SEQ ID NO: 108238 - DNA, 25 bp, mus musculus
tgctgctgggctctgtacagggcta

SEQ ID NO: 108239 - DNA, 25 bp, mus musculus
cagaccagttcctatgcagtgggat

SEQ ID NO: 108240 - DNA, 25 bp, mus musculus
agttcctatgcagtgggatggagga

SEQ ID NO: 108241 - DNA, 25 bp, mus musculus
taatacctctgagcgttctcactcc

SEQ ID NO: 108242 - DNA, 25 bp, mus musculus
ctctgagcgttctcactcctggata

SEQ ID NO: 108243 - DNA, 25 bp, mus musculus
tcactcctggatacataaatcttgg

SEQ ID NO: 108244 - DNA, 25 bp, mus musculus
cgggacctctgtgccacctgtgaag

SEQ ID NO: 108245 - DNA, 25 bp, mus musculus
ctctgtgccacctgtgaagcaagtc

SEQ ID NO: 108246 - DNA, 25 bp, mus musculus
gccacctgtgaagcaagtctctctc

SEQ ID NO: 108247 - DNA, 25 bp, mus musculus
tggatgacccgtgctccttttgctt

SEQ ID NO: 108248 - DNA, 25 bp, mus musculus
gctccttttgctttcacacggaatt

SEQ ID NO: 108249 - DNA, 25 bp, mus musculus
tttgctttcacacggaatttcccag

SEQ ID NO: 108250 - DNA, 25 bp, mus musculus
ttcacacggaatttcccagttatgt

SEQ ID NO: 108251 - DNA, 25 bp, mus musculus
tgcgcaagaaacctccacgtggtgt

SEQ ID NO: 108252 - DNA, 25 bp, mus musculus
ttctgccaagggacttccacattag

SEQ ID NO: 108253 - DNA, 25 bp, mus musculus
tggactttctgccactttaacatgg

SEQ ID NO: 108254 - DNA, 25 bp, mus musculus
cactttaacatggtcactgactcct

SEQ ID NO: 108255 - DNA, 25 bp, mus musculus
aacatggtcactgactcctttatta

SEQ ID NO: 108256 - DNA, 25 bp, mus musculus
gtcactgactcctttattaggtctg

SEQ ID NO: 108257 - DNA, 25 bp, mus musculus
gaacttcctgtctaatacctctgag

SEQ ID NO: 108258 - DNA, 25 bp, mus musculus
cctgtctaatacctctgagcgttct

SEQ ID NO: 108259 - DNA, 25 bp, mus musculus
cccatgtcatccgtatcaacaagat

SEQ ID NO: 108260 - DNA, 25 bp, mus musculus
ccatgtcatccgtatcaacaagatg

SEQ ID NO: 108261 - DNA, 25 bp, mus musculus
cgaggctctgcgaacatcagagttc

SEQ ID NO: 108262 - DNA, 25 bp, mus musculus
atcagagttcaagttccctgggcgc

SEQ ID NO: 108263 - DNA, 25 bp, mus musculus
tcagagttcaagttccctgggcgcc

SEQ ID NO: 108264 - DNA, 25 bp, mus musculus
aagttgggcatcaccaagtttactg

SEQ ID NO: 108265 - DNA, 25 bp, mus musculus
gttgggcatcaccaagtttactgca

SEQ ID NO: 108266 - DNA, 25 bp, mus musculus
ttgggcatcaccaagtttactgcag

SEQ ID NO: 108267 - DNA, 25 bp, mus musculus
tgggcatcaccaagtttactgcaga

SEQ ID NO: 108268 - DNA, 25 bp, mus musculus
atttgaagacactgttgctgacaaa

SEQ ID NO: 108269 - DNA, 25 bp, mus musculus
agacactgttgctgacaaacggatc

SEQ ID NO: 108270 - DNA, 25 bp, mus musculus
gacactgttgctgacaaacggatca

SEQ ID NO: 108271 - DNA, 25 bp, mus musculus
catgtcatccgtatcaacaagatgt

SEQ ID NO: 108272 - DNA, 25 bp, mus musculus
acactgttgctgacaaacggatcat

SEQ ID NO: 108273 - DNA, 25 bp, mus musculus
tgtcatccgtatcaacaagatgtag

SEQ ID NO: 108274 - DNA, 25 bp, mus musculus
gtcatccgtatcaacaagatgtagt

SEQ ID NO: 108275 - DNA, 25 bp, mus musculus
tcatccgtatcaacaagatgtagtc

SEQ ID NO: 108276 - DNA, 25 bp, mus musculus
atccgtatcaacaagatgtagtcct

SEQ ID NO: 108277 - DNA, 25 bp, mus musculus
tgatcgaggctctgcgaacatcaga

SEQ ID NO: 108278 - DNA, 25 bp, mus musculus
gatcgaggctctgcgaacatcagag

SEQ ID NO: 108279 - DNA, 25 bp, mus musculus
tcgaggctctgcgaacatcagagtt

SEQ ID NO: 108280 - DNA, 25 bp, mus musculus
tagctggactgcagccttctccgtg

SEQ ID NO: 108281 - DNA, 25 bp, mus musculus
ttctccgtggaactcgccaagccag

SEQ ID NO: 108282 - DNA, 25 bp, mus musculus
cctctaatgtctgacgttttgagta

SEQ ID NO: 108283 - DNA, 25 bp, mus musculus
tctaatgtctgacgttttgagtatc

SEQ ID NO: 108284 - DNA, 25 bp, mus musculus
taatgtctgacgttttgagtatcta

SEQ ID NO: 108285 - DNA, 25 bp, mus musculus
ttattaagtcccaatgtgaaatctg

SEQ ID NO: 108286 - DNA, 25 bp, mus musculus
attaagtcccaatgtgaaatctgtc

SEQ ID NO: 108287 - DNA, 25 bp, mus musculus
tgtgaaatctgtcagcctagctgtg

SEQ ID NO: 108288 - DNA, 25 bp, mus musculus
aaatctgtcagcctagctgtgtggt

SEQ ID NO: 108289 - DNA, 25 bp, mus musculus
atctgtcagcctagctgtgtggtcg

SEQ ID NO: 108290 - DNA, 25 bp, mus musculus
ctgtcagcctagctgtgtggtcgga

SEQ ID NO: 108291 - DNA, 25 bp, mus musculus
gtcagcctagctgtgtggtcggaag

SEQ ID NO: 108292 - DNA, 25 bp, mus musculus
ctccgtggaactcgccaagccagcg

SEQ ID NO: 108293 - DNA, 25 bp, mus musculus
tcagcctagctgtgtggtcggaagg

SEQ ID NO: 108294 - DNA, 25 bp, mus musculus
ccgtggaactcgccaagccagcgat

SEQ ID NO: 108295 - DNA, 25 bp, mus musculus
tgtgctccgaccggacagggagccc

SEQ ID NO: 108296 - DNA, 25 bp, mus musculus
gggactacatgggctggatggattt

SEQ ID NO: 108297 - DNA, 25 bp, mus musculus
gactacatgggctggatggattttg

SEQ ID NO: 108298 - DNA, 25 bp, mus musculus
gactacgaatacccatcgtagtggg

SEQ ID NO: 108299 - DNA, 25 bp, mus musculus
tgaggaaacaaccacacatacgacc

SEQ ID NO: 108300 - DNA, 25 bp, mus musculus
cgcctctaatgtctgacgttttgag

SEQ ID NO: 108301 - DNA, 25 bp, mus musculus
gtgttgccttgtcctgttgtctctg

SEQ ID NO: 108302 - DNA, 25 bp, mus musculus
ttgccttgtcctgttgtctctgtac

SEQ ID NO: 108303 - DNA, 25 bp, mus musculus
attctttgtatgcacatattcaatt

SEQ ID NO: 108304 - DNA, 25 bp, mus musculus
atgcacatattcaattctactgatc

SEQ ID NO: 108305 - DNA, 25 bp, mus musculus
cacatattcaattctactgatcatc

SEQ ID NO: 108306 - DNA, 25 bp, mus musculus
atattcaattctactgatcatctgg

SEQ ID NO: 108307 - DNA, 25 bp, mus musculus
aattctactgatcatctggtcagct

SEQ ID NO: 108308 - DNA, 25 bp, mus musculus
actgatcatctggtcagctaacata

SEQ ID NO: 108309 - DNA, 25 bp, mus musculus
gatcatctggtcagctaacataagt

SEQ ID NO: 108310 - DNA, 25 bp, mus musculus
catctggtcagctaacataagtacg

SEQ ID NO: 108311 - DNA, 25 bp, mus musculus
cataagtacggtcttcatagtgaac

SEQ ID NO: 108312 - DNA, 25 bp, mus musculus
tcatagtgaacctccttgaacagaa

SEQ ID NO: 108313 - DNA, 25 bp, mus musculus
aggactaacagtcatgcttcttttc

SEQ ID NO: 108314 - DNA, 25 bp, mus musculus
catagtgaacctccttgaacagaag

SEQ ID NO: 108315 - DNA, 25 bp, mus musculus
actaacagtcatgcttcttttcctc

SEQ ID NO: 108316 - DNA, 25 bp, mus musculus
aacagtcatgcttcttttcctcttc

SEQ ID NO: 108317 - DNA, 25 bp, mus musculus
agattctaaacacttattacagtga

SEQ ID NO: 108318 - DNA, 25 bp, mus musculus
ttctaaacacttattacagtgacgc

SEQ ID NO: 108319 - DNA, 25 bp, mus musculus
taaacacttattacagtgacgccca

SEQ ID NO: 108320 - DNA, 25 bp, mus musculus
acacttattacagtgacgcccaata

SEQ ID NO: 108321 - DNA, 25 bp, mus musculus
attacagtgacgcccaatacccatt

SEQ ID NO: 108322 - DNA, 25 bp, mus musculus
caacatcggatcctgctctgattac

SEQ ID NO: 108323 - DNA, 25 bp, mus musculus
cggatcctgctctgattacccatcg

SEQ ID NO: 108324 - DNA, 25 bp, mus musculus
gacaacccaactgacatcttcctat

SEQ ID NO: 108325 - DNA, 25 bp, mus musculus
ccaactgacatcttcctatggaaat

SEQ ID NO: 108326 - DNA, 25 bp, mus musculus
gacatcttcctatggaaatttgccc

SEQ ID NO: 108327 - DNA, 25 bp, mus musculus
ctctccacaaaagaagtagaatgtt

SEQ ID NO: 108328 - DNA, 25 bp, mus musculus
ctcagtgccccgagaatgttatcta

SEQ ID NO: 108329 - DNA, 25 bp, mus musculus
cattaatagctccctacagaacttt

SEQ ID NO: 108330 - DNA, 25 bp, mus musculus
tagctccctacagaactttcataca

SEQ ID NO: 108331 - DNA, 25 bp, mus musculus
cctacagaactttcatacagttgca

SEQ ID NO: 108332 - DNA, 25 bp, mus musculus
agttgcacccaagttgctgatgtgt

SEQ ID NO: 108333 - DNA, 25 bp, mus musculus
gttgctgatgtgttctctagaatag

SEQ ID NO: 108334 - DNA, 25 bp, mus musculus
ctgctctgattacccatcgtcccta

SEQ ID NO: 108335 - DNA, 25 bp, mus musculus
gagtccaggattgctctaggacagg

SEQ ID NO: 108336 - DNA, 25 bp, mus musculus
gctctaggacaggtggcaggatctg

SEQ ID NO: 108337 - DNA, 25 bp, mus musculus
actggcttcatatccattcacaagg

SEQ ID NO: 108338 - DNA, 25 bp, mus musculus
ttcatatccattcacaaggaccagc

SEQ ID NO: 108339 - DNA, 25 bp, mus musculus
ccttggcaggccaatggaacacctc

SEQ ID NO: 108340 - DNA, 25 bp, mus musculus
aatggaacacctcttctgccaccat

SEQ ID NO: 108341 - DNA, 25 bp, mus musculus
ccaccatgctgtgacaacccaactg

SEQ ID NO: 108342 - DNA, 25 bp, mus musculus
ccatccagactataatcctgatgac

SEQ ID NO: 108343 - DNA, 25 bp, mus musculus
tccagactataatcctgatgaccgt

SEQ ID NO: 108344 - DNA, 25 bp, mus musculus
aagttcttacaacagagctaatgag

SEQ ID NO: 108345 - DNA, 25 bp, mus musculus
agctgcaggcatcgtctcctacggg

SEQ ID NO: 108346 - DNA, 25 bp, mus musculus
tgcaggcatcgtctcctacgggcaa

SEQ ID NO: 108347 - DNA, 25 bp, mus musculus
cgtctcctacgggcaaactgatgga

SEQ ID NO: 108348 - DNA, 25 bp, mus musculus
ctcctacgggcaaactgatggatca

SEQ ID NO: 108349 - DNA, 25 bp, mus musculus
tgatggatcagctccacaagtcttc

SEQ ID NO: 108350 - DNA, 25 bp, mus musculus
tccacaagtcttcacaagagttttg

SEQ ID NO: 108351 - DNA, 25 bp, mus musculus
aaactagatcctgatctgaccagcc

SEQ ID NO: 108352 - DNA, 25 bp, mus musculus
ctagatcctgatctgaccagccatc

SEQ ID NO: 108353 - DNA, 25 bp, mus musculus
gatctgaccagccatcttccccata

SEQ ID NO: 108354 - DNA, 25 bp, mus musculus
taatcctgatgaccgttctaatgac

SEQ ID NO: 108355 - DNA, 25 bp, mus musculus
tcctgatgaccgttctaatgacatc

SEQ ID NO: 108356 - DNA, 25 bp, mus musculus
tgatgaccgttctaatgacatcatg

SEQ ID NO: 108357 - DNA, 25 bp, mus musculus
caatgctcatgtgaagccaggggat

SEQ ID NO: 108358 - DNA, 25 bp, mus musculus
aacactgcacgaagttaagctgaca

SEQ ID NO: 108359 - DNA, 25 bp, mus musculus
gtgtgagtcccagttccaaagttct

SEQ ID NO: 108360 - DNA, 25 bp, mus musculus
gttccaaagttcttacaacagagct

SEQ ID NO: 108361 - DNA, 25 bp, mus musculus
ccaaagttcttacaacagagctaat

SEQ ID NO: 108362 - DNA, 25 bp, mus musculus
ccctcgacctggacattcggcacga

SEQ ID NO: 108363 - DNA, 25 bp, mus musculus
ctcgacctggacattcggcacgagg

SEQ ID NO: 108364 - DNA, 25 bp, mus musculus
ccggcctcacactagtgtcgcatgt

SEQ ID NO: 108365 - DNA, 25 bp, mus musculus
cctcacactagtgtcgcatgtccac

SEQ ID NO: 108366 - DNA, 25 bp, mus musculus
tcacactagtgtcgcatgtccacta

SEQ ID NO: 108367 - DNA, 25 bp, mus musculus
acactagtgtcgcatgtccactatc

SEQ ID NO: 108368 - DNA, 25 bp, mus musculus
actagtgtcgcatgtccactatcca

SEQ ID NO: 108369 - DNA, 25 bp, mus musculus
ctttgctgatgcaactaagggccga

SEQ ID NO: 108370 - DNA, 25 bp, mus musculus
tactcccggcacgacttgaggacta

SEQ ID NO: 108371 - DNA, 25 bp, mus musculus
ctcccggcacgacttgaggactaca

SEQ ID NO: 108372 - DNA, 25 bp, mus musculus
cccggcacgacttgaggactacatt

SEQ ID NO: 108373 - DNA, 25 bp, mus musculus
aggactacattcatataaggatcca

SEQ ID NO: 108374 - DNA, 25 bp, mus musculus
cgacctggacattcggcacgaggct

SEQ ID NO: 108375 - DNA, 25 bp, mus musculus
ataaggatccagcagcgcaacggca

SEQ ID NO: 108376 - DNA, 25 bp, mus musculus
ctggacattcggcacgaggcttcct

SEQ ID NO: 108377 - DNA, 25 bp, mus musculus
ggcttccgcgcttcattgatttccg

SEQ ID NO: 108378 - DNA, 25 bp, mus musculus
cgcgcttcattgatttccgtttctc

SEQ ID NO: 108379 - DNA, 25 bp, mus musculus
cgcttcattgatttccgtttctcgc

SEQ ID NO: 108380 - DNA, 25 bp, mus musculus
ccgctgcagcctcctgacacggtga

SEQ ID NO: 108381 - DNA, 25 bp, mus musculus
tgcagcctcctgacacggtgatccg

SEQ ID NO: 108382 - DNA, 25 bp, mus musculus
gaattctatcctctcaccggcctca

SEQ ID NO: 108383 - DNA, 25 bp, mus musculus
acttcaccaacatgtttgctacttg

SEQ ID NO: 108384 - DNA, 25 bp, mus musculus
tgtttgctacttggtctccttcaca

SEQ ID NO: 108385 - DNA, 25 bp, mus musculus
attctctagacccaccattactcac

SEQ ID NO: 108386 - DNA, 25 bp, mus musculus
caccattactcactcgctatcttcg

SEQ ID NO: 108387 - DNA, 25 bp, mus musculus
tactcactcgctatcttcgaattca

SEQ ID NO: 108388 - DNA, 25 bp, mus musculus
acccccagatctgggagcaccaaat

SEQ ID NO: 108389 - DNA, 25 bp, mus musculus
gggagcaccaaattgctctgaggct

SEQ ID NO: 108390 - DNA, 25 bp, mus musculus
accaaattgctctgaggcttgagat

SEQ ID NO: 108391 - DNA, 25 bp, mus musculus
ttctaggatgtgaggcccagcagca

SEQ ID NO: 108392 - DNA, 25 bp, mus musculus
aatactgaggtagcctctgcatcac

SEQ ID NO: 108393 - DNA, 25 bp, mus musculus
ccttcctcagctcaaagattgtctt

SEQ ID NO: 108394 - DNA, 25 bp, mus musculus
cactatgaccatggcaactctttat

SEQ ID NO: 108395 - DNA, 25 bp, mus musculus
ggtctccttcacaagctcgacttca

SEQ ID NO: 108396 - DNA, 25 bp, mus musculus
aatctctctttaccagcatgtttgt

SEQ ID NO: 108397 - DNA, 25 bp, mus musculus
agttccttatttccagcagtcaaga

SEQ ID NO: 108398 - DNA, 25 bp, mus musculus
ttatttccagcagtcaagatggcca

SEQ ID NO: 108399 - DNA, 25 bp, mus musculus
gtcaagatggccatcactggactca

SEQ ID NO: 108400 - DNA, 25 bp, mus musculus
ggaatcaggactcatccacacctat

SEQ ID NO: 108401 - DNA, 25 bp, mus musculus
catccacacctatgatgaattctct

SEQ ID NO: 108402 - DNA, 25 bp, mus musculus
tgatgaattctctagacccaccatt

SEQ ID NO: 108403 - DNA, 25 bp, mus musculus
caaagtccccgatgccagtgctgcc

SEQ ID NO: 108404 - DNA, 25 bp, mus musculus
aaagtccccgatgccagtgctgcca

SEQ ID NO: 108405 - DNA, 25 bp, mus musculus
ggctgcccgcaaggagccagctaag

SEQ ID NO: 108406 - DNA, 25 bp, mus musculus
ctgcccgcaaggagccagctaagac

SEQ ID NO: 108407 - DNA, 25 bp, mus musculus
gcccgcaaggagccagctaagactc

SEQ ID NO: 108408 - DNA, 25 bp, mus musculus
cccgcaaggagccagctaagactca

SEQ ID NO: 108409 - DNA, 25 bp, mus musculus
gagccagctaagactcagcctatgg

SEQ ID NO: 108410 - DNA, 25 bp, mus musculus
agccagctaagactcagcctatggt

SEQ ID NO: 108411 - DNA, 25 bp, mus musculus
ccagctaagactcagcctatggtcg

SEQ ID NO: 108412 - DNA, 25 bp, mus musculus
cagctaagactcagcctatggtcgc

SEQ ID NO: 108413 - DNA, 25 bp, mus musculus
agctaagactcagcctatggtcgcg

SEQ ID NO: 108414 - DNA, 25 bp, mus musculus
ctaagactcagcctatggtcgcgac

SEQ ID NO: 108415 - DNA, 25 bp, mus musculus
aagtccccgatgccagtgctgccat

SEQ ID NO: 108416 - DNA, 25 bp, mus musculus
taagactcagcctatggtcgcgaca

SEQ ID NO: 108417 - DNA, 25 bp, mus musculus
ccgatgccagtgctgccatgcccag

SEQ ID NO: 108418 - DNA, 25 bp, mus musculus
cgatgccagtgctgccatgcccagc

SEQ ID NO: 108419 - DNA, 25 bp, mus musculus
gatgccagtgctgccatgcccagcc

SEQ ID NO: 108420 - DNA, 25 bp, mus musculus
ccctgagcctgaggagttgagcagc

SEQ ID NO: 108421 - DNA, 25 bp, mus musculus
aggctcactgggaagcgatggctgc

SEQ ID NO: 108422 - DNA, 25 bp, mus musculus
ggctcactgggaagcgatggctgcc

SEQ ID NO: 108423 - DNA, 25 bp, mus musculus
tcactgggaagcgatggctgcccgc

SEQ ID NO: 108424 - DNA, 25 bp, mus musculus
agcccccattcttcagtgctcagca

SEQ ID NO: 108425 - DNA, 25 bp, mus musculus
tcagtgctcagcaatccaactcatt

SEQ ID NO: 108426 - DNA, 25 bp, mus musculus
tttcctgggacctagcaggtggaca

SEQ ID NO: 108427 - DNA, 25 bp, mus musculus
gtggacagcatctcaatggaattaa

SEQ ID NO: 108428 - DNA, 25 bp, mus musculus
aagcatacagagcctatcagaatta

SEQ ID NO: 108429 - DNA, 25 bp, mus musculus
gacttgacctcaatcacaaacaact

SEQ ID NO: 108430 - DNA, 25 bp, mus musculus
cctaccggccagagtatgcagtcaa

SEQ ID NO: 108431 - DNA, 25 bp, mus musculus
cagatgtacacagtcctggaaattt

SEQ ID NO: 108432 - DNA, 25 bp, mus musculus
tacacagtcctggaaatttcaggat

SEQ ID NO: 108433 - DNA, 25 bp, mus musculus
actctgccgagtttgcagatgcctt

SEQ ID NO: 108434 - DNA, 25 bp, mus musculus
ttgcagatgcctttcattgccgcaa

SEQ ID NO: 108435 - DNA, 25 bp, mus musculus
ttcattgccgcaagaattcatacat

SEQ ID NO: 108436 - DNA, 25 bp, mus musculus
ctcagcaatccaactcattgaacta

SEQ ID NO: 108437 - DNA, 25 bp, mus musculus
aatccaactcattgaactatggggg

SEQ ID NO: 108438 - DNA, 25 bp, mus musculus
actcattgaactatgggggcatcgg

SEQ ID NO: 108439 - DNA, 25 bp, mus musculus
tgaactatgggggcatcggcatggt

SEQ ID NO: 108440 - DNA, 25 bp, mus musculus
aaatcacacatggatttgatgacaa

SEQ ID NO: 108441 - DNA, 25 bp, mus musculus
gagacctcgttgactggtggacgca

SEQ ID NO: 108442 - DNA, 25 bp, mus musculus
ttaaagaccaatcccagtgtatggt

SEQ ID NO: 108443 - DNA, 25 bp, mus musculus
accaatcccagtgtatggtatacca

SEQ ID NO: 108444 - DNA, 25 bp, mus musculus
tagtcacaattcactgcgggatgct

SEQ ID NO: 108445 - DNA, 25 bp, mus musculus
caattcactgcgggatgctgcaggc

SEQ ID NO: 108446 - DNA, 25 bp, mus musculus
taggaaccctagcccagatgagctg

SEQ ID NO: 108447 - DNA, 25 bp, mus musculus
cccagatgagctgccccaagtgggg

SEQ ID NO: 108448 - DNA, 25 bp, mus musculus
cgtagtcaccgccggagctccatca

SEQ ID NO: 108449 - DNA, 25 bp, mus musculus
cggagctccatcatcccaagcagtg

SEQ ID NO: 108450 - DNA, 25 bp, mus musculus
tccatcatcccaagcagtggccttg

SEQ ID NO: 108451 - DNA, 25 bp, mus musculus
agcagtggccttgtcaggaactctg

SEQ ID NO: 108452 - DNA, 25 bp, mus musculus
ggccttgtcaggaactctggctttg

SEQ ID NO: 108453 - DNA, 25 bp, mus musculus
gtcaggaactctggctttgctccta

SEQ ID NO: 108454 - DNA, 25 bp, mus musculus
actcctgaaagttgtccatctgtgc

SEQ ID NO: 108455 - DNA, 25 bp, mus musculus
gaaagttgtccatctgtgctcacaa

SEQ ID NO: 108456 - DNA, 25 bp, mus musculus
tgcaggcgctccgagttgtgactgg

SEQ ID NO: 108457 - DNA, 25 bp, mus musculus
cgctccgagttgtgactggcccagt

SEQ ID NO: 108458 - DNA, 25 bp, mus musculus
gcccagtcagctaaactcgctcaat

SEQ ID NO: 108459 - DNA, 25 bp, mus musculus
gctcaatctgtctttcactgggctg

SEQ ID NO: 108460 - DNA, 25 bp, mus musculus
tttcactgggctgaagcaggtacct

SEQ ID NO: 108461 - DNA, 25 bp, mus musculus
gctgccagccaagctcagcgtgctg

SEQ ID NO: 108462 - DNA, 25 bp, mus musculus
agccaagctcagcgtgctggatctc

SEQ ID NO: 108463 - DNA, 25 bp, mus musculus
gctcagcgtgctggatctcagttac

SEQ ID NO: 108464 - DNA, 25 bp, mus musculus
cgccgtctggctgttcctagccgac

SEQ ID NO: 108465 - DNA, 25 bp, mus musculus
ttctctttacaaccccactgacaca

SEQ ID NO: 108466 - DNA, 25 bp, mus musculus
cagaacacgagggcactcctgagcg

SEQ ID NO: 108467 - DNA, 25 bp, mus musculus
gagagtgacccggaagcagaagtgt

SEQ ID NO: 108468 - DNA, 25 bp, mus musculus
agagtgacccggaagcagaagtgtt

SEQ ID NO: 108469 - DNA, 25 bp, mus musculus
tgacccggaagcagaagtgttcctt

SEQ ID NO: 108470 - DNA, 25 bp, mus musculus
cagaagtgttccttgccgtggagtg

SEQ ID NO: 108471 - DNA, 25 bp, mus musculus
agaagtgttccttgccgtggagtgc

SEQ ID NO: 108472 - DNA, 25 bp, mus musculus
gaagtgttccttgccgtggagtgct

SEQ ID NO: 108473 - DNA, 25 bp, mus musculus
aagtgttccttgccgtggagtgctg

SEQ ID NO: 108474 - DNA, 25 bp, mus musculus
agtgttccttgccgtggagtgctgg

SEQ ID NO: 108475 - DNA, 25 bp, mus musculus
agcagcgaccacagcgggagaagca

SEQ ID NO: 108476 - DNA, 25 bp, mus musculus
caaccccactgacacagaacacgag

SEQ ID NO: 108477 - DNA, 25 bp, mus musculus
accccactgacacagaacacgaggg

SEQ ID NO: 108478 - DNA, 25 bp, mus musculus
ccccactgacacagaacacgagggc

SEQ ID NO: 108479 - DNA, 25 bp, mus musculus
ccactgacacagaacacgagggcac

SEQ ID NO: 108480 - DNA, 25 bp, mus musculus
cactgacacagaacacgagggcact

SEQ ID NO: 108481 - DNA, 25 bp, mus musculus
ctgacacagaacacgagggcactcc

SEQ ID NO: 108482 - DNA, 25 bp, mus musculus
tgacacagaacacgagggcactcct

SEQ ID NO: 108483 - DNA, 25 bp, mus musculus
acacagaacacgagggcactcctga

SEQ ID NO: 108484 - DNA, 25 bp, mus musculus
cactcaaattctctgaagccggccc

SEQ ID NO: 108485 - DNA, 25 bp, mus musculus
ctgaagccggcccttgtgtgggata

SEQ ID NO: 108486 - DNA, 25 bp, mus musculus
ctggcaacactacctgagtgcctgc

SEQ ID NO: 108487 - DNA, 25 bp, mus musculus
acactacctgagtgcctgctcaggg

SEQ ID NO: 108488 - DNA, 25 bp, mus musculus
tgcctgctcagggggttcagcttct

SEQ ID NO: 108489 - DNA, 25 bp, mus musculus
agcttctgaccatatgtagacacca

SEQ ID NO: 108490 - DNA, 25 bp, mus musculus
accccagctctgagtttacacatca

SEQ ID NO: 108491 - DNA, 25 bp, mus musculus
cttcgcccaggtgtgccatttccct

SEQ ID NO: 108492 - DNA, 25 bp, mus musculus
ctgtgaacctactcaagtgctgctc

SEQ ID NO: 108493 - DNA, 25 bp, mus musculus
acctactcaagtgctgctctcaata

SEQ ID NO: 108494 - DNA, 25 bp, mus musculus
tcaagtgctgctctcaataaatctg

SEQ ID NO: 108495 - DNA, 25 bp, mus musculus
gctgctctcaataaatctgccttta

SEQ ID NO: 108496 - DNA, 25 bp, mus musculus
ccagccctgagtcacccagaggaag

SEQ ID NO: 108497 - DNA, 25 bp, mus musculus
tcaataaatctgcctttatactttc

SEQ ID NO: 108498 - DNA, 25 bp, mus musculus
ctgagtcacccagaggaaggagaac

SEQ ID NO: 108499 - DNA, 25 bp, mus musculus
tctgagtacatcctggctctagcct

SEQ ID NO: 108500 - DNA, 25 bp, mus musculus
gtccagccgctacattccatggtgt

SEQ ID NO: 108501 - DNA, 25 bp, mus musculus
tcaccctgcacaaactgggaaacac

SEQ ID NO: 108502 - DNA, 25 bp, mus musculus
gaaacactgtctgcctctcttttaa

SEQ ID NO: 108503 - DNA, 25 bp, mus musculus
cctgctccaggctaacaggccagta

SEQ ID NO: 108504 - DNA, 25 bp, mus musculus
gagtttctggcaacactacctgagt

SEQ ID NO: 108505 - DNA, 25 bp, mus musculus
tgtttcgtcagtttccatagtttag

SEQ ID NO: 108506 - DNA, 25 bp, mus musculus
gaacaaacacaactgcaaatgtgcg

SEQ ID NO: 108507 - DNA, 25 bp, mus musculus
gtgacatacagctttggggtttgtt

SEQ ID NO: 108508 - DNA, 25 bp, mus musculus
tacagctttggggtttgttggcaag

SEQ ID NO: 108509 - DNA, 25 bp, mus musculus
gtgtaaaatccaacaccaacagtat

SEQ ID NO: 108510 - DNA, 25 bp, mus musculus
tttgctaccttagatacaaacctgc

SEQ ID NO: 108511 - DNA, 25 bp, mus musculus
gatacaaacctgccaattaatgata

SEQ ID NO: 108512 - DNA, 25 bp, mus musculus
aacctgccaattaatgataactcca

SEQ ID NO: 108513 - DNA, 25 bp, mus musculus
aatgataactccaagggcctccaat

SEQ ID NO: 108514 - DNA, 25 bp, mus musculus
aatgccataatgaccatcttaggac

SEQ ID NO: 108515 - DNA, 25 bp, mus musculus
accatcttaggacacagtctctatg

SEQ ID NO: 108516 - DNA, 25 bp, mus musculus
ttaggacacagtctctatggaaatt

SEQ ID NO: 108517 - DNA, 25 bp, mus musculus
acacaactgcaaatgtgcgtacctg

SEQ ID NO: 108518 - DNA, 25 bp, mus musculus
atgtgcgtacctgccagaaacaagc

SEQ ID NO: 108519 - DNA, 25 bp, mus musculus
ctgttggcagtgttttatgggattt

SEQ ID NO: 108520 - DNA, 25 bp, mus musculus
gaaagcatacttcctgcccaaacag

SEQ ID NO: 108521 - DNA, 25 bp, mus musculus
gacgctctgaggttagttggcaagt

SEQ ID NO: 108522 - DNA, 25 bp, mus musculus
tgtaaagtccaacaccaacctggct

SEQ ID NO: 108523 - DNA, 25 bp, mus musculus
caccaacctggctgtactctgtatt

SEQ ID NO: 108524 - DNA, 25 bp, mus musculus
cctggctgtactctgtatttttcaa

SEQ ID NO: 108525 - DNA, 25 bp, mus musculus
agatcattcattctgattgcttcat

SEQ ID NO: 108526 - DNA, 25 bp, mus musculus
tcattcattctgattgcttcatggt

SEQ ID NO: 108527 - DNA, 25 bp, mus musculus
gacactgtgacggtcgtgtgcattg

SEQ ID NO: 108528 - DNA, 25 bp, mus musculus
actgtgacggtcgtgtgcattgtgg

SEQ ID NO: 108529 - DNA, 25 bp, mus musculus
taacttttgtggctttgggactgtg

SEQ ID NO: 108530 - DNA, 25 bp, mus musculus
aattgaatccaaggcctcttgcatg

SEQ ID NO: 108531 - DNA, 25 bp, mus musculus
tgaatccaaggcctcttgcatgcta

SEQ ID NO: 108532 - DNA, 25 bp, mus musculus
atccaaggcctcttgcatgctaagc

SEQ ID NO: 108533 - DNA, 25 bp, mus musculus
aagcaagtgctgtaccactgagcta

SEQ ID NO: 108534 - DNA, 25 bp, mus musculus
ctgtaccactgagctacactcagtg

SEQ ID NO: 108535 - DNA, 25 bp, mus musculus
cactgagctacactcagtgtagatt

SEQ ID NO: 108536 - DNA, 25 bp, mus musculus
gctacactcagtgtagatttgagaa

SEQ ID NO: 108537 - DNA, 25 bp, mus musculus
attctgattgcttcatggtgtgaaa

SEQ ID NO: 108538 - DNA, 25 bp, mus musculus
ctgattgcttcatggtgtgaaatga

SEQ ID NO: 108539 - DNA, 25 bp, mus musculus
attgcttcatggtgtgaaatgagga

SEQ ID NO: 108540 - DNA, 25 bp, mus musculus
atgttaggcttcgtctttcacagat

SEQ ID NO: 108541 - DNA, 25 bp, mus musculus
ggcttcgtctttcacagattatgag

SEQ ID NO: 108542 - DNA, 25 bp, mus musculus
ttcgtctttcacagattatgaggac

SEQ ID NO: 108543 - DNA, 25 bp, mus musculus
gtctttcacagattatgaggacatg

SEQ ID NO: 108544 - DNA, 25 bp, mus musculus
ttagacactgtgacggtcgtgtgca

SEQ ID NO: 108545 - DNA, 25 bp, mus musculus
ccagtggaccaacctgaacgcacca

SEQ ID NO: 108546 - DNA, 25 bp, mus musculus
gtggaccaacctgaacgcaccattc

SEQ ID NO: 108547 - DNA, 25 bp, mus musculus
agcttccagaacaagcactgtggaa

SEQ ID NO: 108548 - DNA, 25 bp, mus musculus
ttccagaacaagcactgtggaaagg

SEQ ID NO: 108549 - DNA, 25 bp, mus musculus
agccgcagcagcgcagaattcagtg

SEQ ID NO: 108550 - DNA, 25 bp, mus musculus
tcctccatcaggcacacagattcac

SEQ ID NO: 108551 - DNA, 25 bp, mus musculus
tccatcaggcacacagattcaccag

SEQ ID NO: 108552 - DNA, 25 bp, mus musculus
aggcacacagattcaccagcagaaa

SEQ ID NO: 108553 - DNA, 25 bp, mus musculus
cacacagattcaccagcagaaaggc

SEQ ID NO: 108554 - DNA, 25 bp, mus musculus
acagattcaccagcagaaaggccct

SEQ ID NO: 108555 - DNA, 25 bp, mus musculus
tcaccagcagaaaggccctccttta

SEQ ID NO: 108556 - DNA, 25 bp, mus musculus
tcagccaaaacctccctgtgggagt

SEQ ID NO: 108557 - DNA, 25 bp, mus musculus
gaccaacctgaacgcaccattcaag

SEQ ID NO: 108558 - DNA, 25 bp, mus musculus
gaacgcaccattcaagtgtgaggcg

SEQ ID NO: 108559 - DNA, 25 bp, mus musculus
cgcaccattcaagtgtgaggcgata

SEQ ID NO: 108560 - DNA, 25 bp, mus musculus
ggcgataaacccggtcagcaaggag

SEQ ID NO: 108561 - DNA, 25 bp, mus musculus
gaaaggtctgtccttctatgtcaca

SEQ ID NO: 108562 - DNA, 25 bp, mus musculus
tgcaggaggactcctcttggtgctc

SEQ ID NO: 108563 - DNA, 25 bp, mus musculus
actcctcttggtgctcttggtggcg

SEQ ID NO: 108564 - DNA, 25 bp, mus musculus
tttctgtatctgcaagaggagaaaa

SEQ ID NO: 108565 - DNA, 25 bp, mus musculus
agatccaaatctaatgtggttctgc

SEQ ID NO: 108566 - DNA, 25 bp, mus musculus
aatgtggttctgctgtcagctggag

SEQ ID NO: 108567 - DNA, 25 bp, mus musculus
cttgtggccttccacaatctattct

SEQ ID NO: 108568 - DNA, 25 bp, mus musculus
gccttccacaatctattctccatat

SEQ ID NO: 108569 - DNA, 25 bp, mus musculus
ttttcacagcttaactttgcataga

SEQ ID NO: 108570 - DNA, 25 bp, mus musculus
cagcttaactttgcatagagaagcc

SEQ ID NO: 108571 - DNA, 25 bp, mus musculus
agaagccacatctagctctccttca

SEQ ID NO: 108572 - DNA, 25 bp, mus musculus
tagctctccttcacatttgaagaat

SEQ ID NO: 108573 - DNA, 25 bp, mus musculus
tttgccttgcttagggagtcttaca

SEQ ID NO: 108574 - DNA, 25 bp, mus musculus
tcttacactggcagaaacgctgaag

SEQ ID NO: 108575 - DNA, 25 bp, mus musculus
atgtgtgtctcagtagtggtaatgg

SEQ ID NO: 108576 - DNA, 25 bp, mus musculus
ttcctccatcagcagttacagcaga

SEQ ID NO: 108577 - DNA, 25 bp, mus musculus
gtatcttcccaaccaaagaatgaag

SEQ ID NO: 108578 - DNA, 25 bp, mus musculus
tccttgccagtggaaaatgagatcg

SEQ ID NO: 108579 - DNA, 25 bp, mus musculus
gagatcgctccttaaactcttttct

SEQ ID NO: 108580 - DNA, 25 bp, mus musculus
agcttccaagacacatagttaccct

SEQ ID NO: 108581 - DNA, 25 bp, mus musculus
caagacacatagttaccctcatctc

SEQ ID NO: 108582 - DNA, 25 bp, mus musculus
acatagttaccctcatctcttgtgg

SEQ ID NO: 108583 - DNA, 25 bp, mus musculus
ttaccctcatctcttgtggccttcc

SEQ ID NO: 108584 - DNA, 25 bp, mus musculus
tcatctcttgtggccttccacaatc

SEQ ID NO: 108585 - DNA, 25 bp, mus musculus
agtcctctatgatgggtcgactgca

SEQ ID NO: 108586 - DNA, 25 bp, mus musculus
agagacctctgacacagtctcagag

SEQ ID NO: 108587 - DNA, 25 bp, mus musculus
tcgacactctagcatctccagagac

SEQ ID NO: 108588 - DNA, 25 bp, mus musculus
ctctccgctgagcagctgatcctac

SEQ ID NO: 108589 - DNA, 25 bp, mus musculus
cagctgatcctacagaaactgccct

SEQ ID NO: 108590 - DNA, 25 bp, mus musculus
atcctacagaaactgccctagttgc

SEQ ID NO: 108591 - DNA, 25 bp, mus musculus
cagaaactgccctagttgcttacta

SEQ ID NO: 108592 - DNA, 25 bp, mus musculus
ctgccctagttgcttactacgcgaa

SEQ ID NO: 108593 - DNA, 25 bp, mus musculus
aagatgtcgtgcacacctcagtgga

SEQ ID NO: 108594 - DNA, 25 bp, mus musculus
tcgtgcacacctcagtggaccatgc

SEQ ID NO: 108595 - DNA, 25 bp, mus musculus
acacctcagtggaccatgccactgc

SEQ ID NO: 108596 - DNA, 25 bp, mus musculus
cagtggaccatgccactgcagttcc

SEQ ID NO: 108597 - DNA, 25 bp, mus musculus
ctctgacacagtctcagagatcctc

SEQ ID NO: 108598 - DNA, 25 bp, mus musculus
ggaccatgccactgcagttccatct

SEQ ID NO: 108599 - DNA, 25 bp, mus musculus
cacagtctcagagatcctcaccaga

SEQ ID NO: 108600 - DNA, 25 bp, mus musculus
ctcagagatcctcaccagatattaa

SEQ ID NO: 108601 - DNA, 25 bp, mus musculus
aaatcactgctatgctctgccagag

SEQ ID NO: 108602 - DNA, 25 bp, mus musculus
ctgctatgctctgccagagtgataa

SEQ ID NO: 108603 - DNA, 25 bp, mus musculus
tgctctgccagagtgataactcata

SEQ ID NO: 108604 - DNA, 25 bp, mus musculus
actcataattactcgacactctagc

SEQ ID NO: 108605 - DNA, 25 bp, mus musculus
aattactcgacactctagcatctcc

SEQ ID NO: 108606 - DNA, 25 bp, mus musculus
catcagaaccctttcctgtgaatac

SEQ ID NO: 108607 - DNA, 25 bp, mus musculus
tgaatactcaacaaactgcccttct

SEQ ID NO: 108608 - DNA, 25 bp, mus musculus
ggtctgacacctttgacctcctctg

SEQ ID NO: 108609 - DNA, 25 bp, mus musculus
ggcatctacaaacacaggacacaca

SEQ ID NO: 108610 - DNA, 25 bp, mus musculus
cacaggacacacacacacacgatta

SEQ ID NO: 108611 - DNA, 25 bp, mus musculus
atgagccaccggaggctctctggta

SEQ ID NO: 108612 - DNA, 25 bp, mus musculus
aggactgactgccgtgagagacact

SEQ ID NO: 108613 - DNA, 25 bp, mus musculus
agacactatctacagacacacagac

SEQ ID NO: 108614 - DNA, 25 bp, mus musculus
tatctacagacacacagacttcctg

SEQ ID NO: 108615 - DNA, 25 bp, mus musculus
cagacacacagacttcctggccttg

SEQ ID NO: 108616 - DNA, 25 bp, mus musculus
ggttctgtcttctctgtaagttgtg

SEQ ID NO: 108617 - DNA, 25 bp, mus musculus
gtcttctctgtaagttgtgacagtg

SEQ ID NO: 108618 - DNA, 25 bp, mus musculus
ctcaacaaactgcccttctgagacc

SEQ ID NO: 108619 - DNA, 25 bp, mus musculus
gagcaggatcccagtgtgtggccca

SEQ ID NO: 108620 - DNA, 25 bp, mus musculus
gatcccagtgtgtggcccagcaagc

SEQ ID NO: 108621 - DNA, 25 bp, mus musculus
agactcaggctctagctataaagca

SEQ ID NO: 108622 - DNA, 25 bp, mus musculus
accgtccagctgacaaaactacatg

SEQ ID NO: 108623 - DNA, 25 bp, mus musculus
aatggctcaccaagggctccagagg

SEQ ID NO: 108624 - DNA, 25 bp, mus musculus
tgattcccagcactgtcaaatggat

SEQ ID NO: 108625 - DNA, 25 bp, mus musculus
ccagctgtaactctactttcagagg

SEQ ID NO: 108626 - DNA, 25 bp, mus musculus
tgtggcttgacccaaactcaagctt

SEQ ID NO: 108627 - DNA, 25 bp, mus musculus
ggcttgacccaaactcaagcttaat

SEQ ID NO: 108628 - DNA, 25 bp, mus musculus
gccagcacatttcagtcatgtggtg

SEQ ID NO: 108629 - DNA, 25 bp, mus musculus
acatttcagtcatgtggtgtgatag

SEQ ID NO: 108630 - DNA, 25 bp, mus musculus
tctctttggctaagttggtgtttgg

SEQ ID NO: 108631 - DNA, 25 bp, mus musculus
tgagccacttagctcctaaatagtg

SEQ ID NO: 108632 - DNA, 25 bp, mus musculus
aatcacattgactcatggaatggcc

SEQ ID NO: 108633 - DNA, 25 bp, mus musculus
cacattgactcatggaatggcctca

SEQ ID NO: 108634 - DNA, 25 bp, mus musculus
ttcctcattcccggtcatgggaact

SEQ ID NO: 108635 - DNA, 25 bp, mus musculus
attcccggtcatgggaactcagtat

SEQ ID NO: 108636 - DNA, 25 bp, mus musculus
atagtcacaacatgatttcagaact

SEQ ID NO: 108637 - DNA, 25 bp, mus musculus
gtcacaacatgatttcagaactaga

SEQ ID NO: 108638 - DNA, 25 bp, mus musculus
caaactcaagcttaatacatttatt

SEQ ID NO: 108639 - DNA, 25 bp, mus musculus
actcaagcttaatacatttattgac

SEQ ID NO: 108640 - DNA, 25 bp, mus musculus
aagatcattcattcagccttgggaa

SEQ ID NO: 108641 - DNA, 25 bp, mus musculus
atcattcattcagccttgggaagtc

SEQ ID NO: 108642 - DNA, 25 bp, mus musculus
agtcaatttgcaggctcctggatga

SEQ ID NO: 108643 - DNA, 25 bp, mus musculus
ccgttttcacttgccagcacatttc

SEQ ID NO: 108644 - DNA, 25 bp, mus musculus
ttttcacttgccagcacatttcagt

SEQ ID NO: 108645 - DNA, 25 bp, mus musculus
tcacttgccagcacatttcagtcat

SEQ ID NO: 108646 - DNA, 25 bp, mus musculus
cacttcgttattcatgatctcacct

SEQ ID NO: 108647 - DNA, 25 bp, mus musculus
cctctcaggcctccttgcgacggaa

SEQ ID NO: 108648 - DNA, 25 bp, mus musculus
atgtcttgagcgtggcttctcctct

SEQ ID NO: 108649 - DNA, 25 bp, mus musculus
gtcccgatacaacagcatcgagtta

SEQ ID NO: 108650 - DNA, 25 bp, mus musculus
atacaacagcatcgagttatgtaac

SEQ ID NO: 108651 - DNA, 25 bp, mus musculus
caacagcatcgagttatgtaacact

SEQ ID NO: 108652 - DNA, 25 bp, mus musculus
gttatgtaacactctggatgtccgc

SEQ ID NO: 108653 - DNA, 25 bp, mus musculus
atgtaacactctggatgtccgcaag

SEQ ID NO: 108654 - DNA, 25 bp, mus musculus
cactctggatgtccgcaagtacatg

SEQ ID NO: 108655 - DNA, 25 bp, mus musculus
ggatgtccgcaagtacatggtccat

SEQ ID NO: 108656 - DNA, 25 bp, mus musculus
tcattcataatgggcgtcatatatg

SEQ ID NO: 108657 - DNA, 25 bp, mus musculus
gtcatatatgcgcttctccgcgaac

SEQ ID NO: 108658 - DNA, 25 bp, mus musculus
ctcaggcctccttgcgacggaactc

SEQ ID NO: 108659 - DNA, 25 bp, mus musculus
aggcctccttgcgacggaactctgc

SEQ ID NO: 108660 - DNA, 25 bp, mus musculus
gacggaactctgcgcctctggcact

SEQ ID NO: 108661 - DNA, 25 bp, mus musculus
actctgcgcctctggcactgtcata

SEQ ID NO: 108662 - DNA, 25 bp, mus musculus
ctgcgcctctggcactgtcataacg

SEQ ID NO: 108663 - DNA, 25 bp, mus musculus
cactgtcataacgggtaccaccaca

SEQ ID NO: 108664 - DNA, 25 bp, mus musculus
aacgggtaccaccacaaggctgatg

SEQ ID NO: 108665 - DNA, 25 bp, mus musculus
taccaccacaaggctgatgcgtcgg

SEQ ID NO: 108666 - DNA, 25 bp, mus musculus
actagcacagcaatcactaacatga

SEQ ID NO: 108667 - DNA, 25 bp, mus musculus
gatgactcatttcatgttaattttc

SEQ ID NO: 108668 - DNA, 25 bp, mus musculus
cctggacacgtgcacactcttcctt

SEQ ID NO: 108669 - DNA, 25 bp, mus musculus
cacactcttcctttgcctaagcttt

SEQ ID NO: 108670 - DNA, 25 bp, mus musculus
cttcctttgcctaagctttagctat

SEQ ID NO: 108671 - DNA, 25 bp, mus musculus
aagctttagctatgcacagaggtaa

SEQ ID NO: 108672 - DNA, 25 bp, mus musculus
cgtcaggagagcctggcaggtcttg

SEQ ID NO: 108673 - DNA, 25 bp, mus musculus
acatcacctgcatggttctgcatac

SEQ ID NO: 108674 - DNA, 25 bp, mus musculus
cctgcatggttctgcatactgtgct

SEQ ID NO: 108675 - DNA, 25 bp, mus musculus
tggttctgcatactgtgctgcatat

SEQ ID NO: 108676 - DNA, 25 bp, mus musculus
tgcatactgtgctgcatatcagatc

SEQ ID NO: 108677 - DNA, 25 bp, mus musculus
gaatatcaagtttcctttggcaaga

SEQ ID NO: 108678 - DNA, 25 bp, mus musculus
aattttccgagctcaagatacatca

SEQ ID NO: 108679 - DNA, 25 bp, mus musculus
aagtttcctttggcaagacagatat

SEQ ID NO: 108680 - DNA, 25 bp, mus musculus
tcaagatacatcactcaccgctcca

SEQ ID NO: 108681 - DNA, 25 bp, mus musculus
attcctcgggttcacgttcatatct

SEQ ID NO: 108682 - DNA, 25 bp, mus musculus
cgggttcacgttcatatctgtcttt

SEQ ID NO: 108683 - DNA, 25 bp, mus musculus
cacgttcatatctgtcttttcatct

SEQ ID NO: 108684 - DNA, 25 bp, mus musculus
tgtcttttcatctgcacacctggac

SEQ ID NO: 108685 - DNA, 25 bp, mus musculus
ttcatctgcacacctggacacgtgc

SEQ ID NO: 108686 - DNA, 25 bp, mus musculus
tgcacacctggacacgtgcacactc

SEQ ID NO: 108687 - DNA, 25 bp, mus musculus
tcacctagctcccttggccaggaat

SEQ ID NO: 108688 - DNA, 25 bp, mus musculus
atgagggagccatggccttggtgaa

SEQ ID NO: 108689 - DNA, 25 bp, mus musculus
taaatggtcttgtgcccttaatcct

SEQ ID NO: 108690 - DNA, 25 bp, mus musculus
atggtcttgtgcccttaatcctact

SEQ ID NO: 108691 - DNA, 25 bp, mus musculus
gtcttgtgcccttaatcctactcat

SEQ ID NO: 108692 - DNA, 25 bp, mus musculus
tcttgtgcccttaatcctactcatc

SEQ ID NO: 108693 - DNA, 25 bp, mus musculus
cttgtgcccttaatcctactcatcc

SEQ ID NO: 108694 - DNA, 25 bp, mus musculus
ttgtgcccttaatcctactcatccc

SEQ ID NO: 108695 - DNA, 25 bp, mus musculus
ttaatcctactcatccccgatctgg

SEQ ID NO: 108696 - DNA, 25 bp, mus musculus
ccgatctggtcccctgttctccata

SEQ ID NO: 108697 - DNA, 25 bp, mus musculus
cgatctggtcccctgttctccatag

SEQ ID NO: 108698 - DNA, 25 bp, mus musculus
atctggtcccctgttctccatagtc

SEQ ID NO: 108699 - DNA, 25 bp, mus musculus
gagccatggccttggtgaaactccc

SEQ ID NO: 108700 - DNA, 25 bp, mus musculus
tggtcccctgttctccatagtcctt

SEQ ID NO: 108701 - DNA, 25 bp, mus musculus
agccatggccttggtgaaactccct

SEQ ID NO: 108702 - DNA, 25 bp, mus musculus
gccatggccttggtgaaactccctg

SEQ ID NO: 108703 - DNA, 25 bp, mus musculus
ggccttggtgaaactccctgcctct

SEQ ID NO: 108704 - DNA, 25 bp, mus musculus
ttggtgaaactccctgcctcttctc

SEQ ID NO: 108705 - DNA, 25 bp, mus musculus
tggtgaaactccctgcctcttctct

SEQ ID NO: 108706 - DNA, 25 bp, mus musculus
ggtgaaactccctgcctcttctctc

SEQ ID NO: 108707 - DNA, 25 bp, mus musculus
gagttgggtactgcttgtggtttag

SEQ ID NO: 108708 - DNA, 25 bp, mus musculus
atccccaaagaacagtggtggctga

SEQ ID NO: 108709 - DNA, 25 bp, mus musculus
aagctgaggccaatcctcaaaatcc

SEQ ID NO: 108710 - DNA, 25 bp, mus musculus
tgtgaccatggtcagctcacaccct

SEQ ID NO: 108711 - DNA, 25 bp, mus musculus
tggtcagctcacaccctggtagatc

SEQ ID NO: 108712 - DNA, 25 bp, mus musculus
gtcagctcacaccctggtagatcat

SEQ ID NO: 108713 - DNA, 25 bp, mus musculus
gctcacaccctggtagatcatggct

SEQ ID NO: 108714 - DNA, 25 bp, mus musculus
tcacaccctggtagatcatggcttc

SEQ ID NO: 108715 - DNA, 25 bp, mus musculus
acaccctggtagatcatggcttctc

SEQ ID NO: 108716 - DNA, 25 bp, mus musculus
accctggtagatcatggcttctcag

SEQ ID NO: 108717 - DNA, 25 bp, mus musculus
gtagatcatggcttctcagtgttct

SEQ ID NO: 108718 - DNA, 25 bp, mus musculus
agatcatggcttctcagtgttctag

SEQ ID NO: 108719 - DNA, 25 bp, mus musculus
atcatggcttctcagtgttctagcc

SEQ ID NO: 108720 - DNA, 25 bp, mus musculus
gctgaggccaatcctcaaaatccta

SEQ ID NO: 108721 - DNA, 25 bp, mus musculus
caatcctcaaaatcctagccaagta

SEQ ID NO: 108722 - DNA, 25 bp, mus musculus
atcctcaaaatcctagccaagtacg

SEQ ID NO: 108723 - DNA, 25 bp, mus musculus
tcaaaatcctagccaagtacgagat

SEQ ID NO: 108724 - DNA, 25 bp, mus musculus
aatcctagccaagtacgagattgat

SEQ ID NO: 108725 - DNA, 25 bp, mus musculus
agatcatgtgaccatggtcagctca

SEQ ID NO: 108726 - DNA, 25 bp, mus musculus
atcatgtgaccatggtcagctcaca

SEQ ID NO: 108727 - DNA, 25 bp, mus musculus
catgtgaccatggtcagctcacacc

SEQ ID NO: 108728 - DNA, 25 bp, mus musculus
aatctgggcaacaatgccaaagacc

SEQ ID NO: 108729 - DNA, 25 bp, mus musculus
ggcaacaatgccaaagaccctcgag

SEQ ID NO: 108730 - DNA, 25 bp, mus musculus
ctcattgcgggacaggatggagttc

SEQ ID NO: 108731 - DNA, 25 bp, mus musculus
cgccagtcaagagcttcagacaagc

SEQ ID NO: 108732 - DNA, 25 bp, mus musculus
gacaagcagactctgttgcaaaatg

SEQ ID NO: 108733 - DNA, 25 bp, mus musculus
gaccagtacagccatctccaaggaa

SEQ ID NO: 108734 - DNA, 25 bp, mus musculus
tgaactcagcaggactcagggtgtc

SEQ ID NO: 108735 - DNA, 25 bp, mus musculus
ttctatccagcacccagaatcaaaa

SEQ ID NO: 108736 - DNA, 25 bp, mus musculus
ccagcacccagaatcaaaacaatgc

SEQ ID NO: 108737 - DNA, 25 bp, mus musculus
tcaaccctacaggtagactgcaagc

SEQ ID NO: 108738 - DNA, 25 bp, mus musculus
aagcttggaggagccagtggtatga

SEQ ID NO: 108739 - DNA, 25 bp, mus musculus
tgtcaaccttgtttggggttctcag

SEQ ID NO: 108740 - DNA, 25 bp, mus musculus
cctcgaggcacgtatcagtgtcaag

SEQ ID NO: 108741 - DNA, 25 bp, mus musculus
ggcacgtatcagtgtcaaggagcaa

SEQ ID NO: 108742 - DNA, 25 bp, mus musculus
aacataggcaccatatccggcttta

SEQ ID NO: 108743 - DNA, 25 bp, mus musculus
ggcaccatatccggctttatcttcg

SEQ ID NO: 108744 - DNA, 25 bp, mus musculus
atatccggctttatcttcgctgagg

SEQ ID NO: 108745 - DNA, 25 bp, mus musculus
gtcatcagcatcttcttccttgctc

SEQ ID NO: 108746 - DNA, 25 bp, mus musculus
agcatcttcttccttgctcttggtg

SEQ ID NO: 108747 - DNA, 25 bp, mus musculus
cttgctcttggtgtatatctcattg

SEQ ID NO: 108748 - DNA, 25 bp, mus musculus
ttggtcacctctggagttctgctgg

SEQ ID NO: 108749 - DNA, 25 bp, mus musculus
acctctggagttctgctggccatct

SEQ ID NO: 108750 - DNA, 25 bp, mus musculus
tggagccctacaggagaaaggctgg

SEQ ID NO: 108751 - DNA, 25 bp, mus musculus
gaagacccttattacacggagaatg

SEQ ID NO: 108752 - DNA, 25 bp, mus musculus
ggctatagctcaggacctggggcct

SEQ ID NO: 108753 - DNA, 25 bp, mus musculus
agctcaggacctggggcctccactg

SEQ ID NO: 108754 - DNA, 25 bp, mus musculus
ggggcctccactgagactcagggaa

SEQ ID NO: 108755 - DNA, 25 bp, mus musculus
aatgtgacccgaggggctcaggaga

SEQ ID NO: 108756 - DNA, 25 bp, mus musculus
caggcacttccagaaacggccattc

SEQ ID NO: 108757 - DNA, 25 bp, mus musculus
gaaacggccattcagcaagacaaca

SEQ ID NO: 108758 - DNA, 25 bp, mus musculus
gccattcagcaagacaacatgtggt

SEQ ID NO: 108759 - DNA, 25 bp, mus musculus
attcagcaagacaacatgtggtggc

SEQ ID NO: 108760 - DNA, 25 bp, mus musculus
ggagttctgctggccatcttgggca

SEQ ID NO: 108761 - DNA, 25 bp, mus musculus
ctgctggccatcttgggcaccactg

SEQ ID NO: 108762 - DNA, 25 bp, mus musculus
ctggccatcttgggcaccactggtt

SEQ ID NO: 108763 - DNA, 25 bp, mus musculus
gccatcttgggcaccactggttatt

SEQ ID NO: 108764 - DNA, 25 bp, mus musculus
ggcaccactggttatttcctgatga

SEQ ID NO: 108765 - DNA, 25 bp, mus musculus
ggttatttcctgatgaaccgtcgca

SEQ ID NO: 108766 - DNA, 25 bp, mus musculus
tatttcctgatgaaccgtcgcagtt

SEQ ID NO: 108767 - DNA, 25 bp, mus musculus
ttcctgatgaaccgtcgcagttgga

SEQ ID NO: 108768 - DNA, 25 bp, mus musculus
gacccagagttgtcttgctgcggcg

SEQ ID NO: 108769 - DNA, 25 bp, mus musculus
tcttgctgcggcgttcactgtaagg

SEQ ID NO: 108770 - DNA, 25 bp, mus musculus
gatccctgggacttcatggtaaaag

SEQ ID NO: 108771 - DNA, 25 bp, mus musculus
gaaccaaatccagagggttgtcatt

SEQ ID NO: 108772 - DNA, 25 bp, mus musculus
ttgacctccatgtgtgctctgtggt

SEQ ID NO: 108773 - DNA, 25 bp, mus musculus
tccatgtgtgctctgtggtaatgta

SEQ ID NO: 108774 - DNA, 25 bp, mus musculus
taatgtaccccgtgtgtgcacatgt

SEQ ID NO: 108775 - DNA, 25 bp, mus musculus
accccgtgtgtgcacatgtgcacat

SEQ ID NO: 108776 - DNA, 25 bp, mus musculus
cacatgtgcacatatcctaaaatgg

SEQ ID NO: 108777 - DNA, 25 bp, mus musculus
tgcacatatcctaaaatggatgtgg

SEQ ID NO: 108778 - DNA, 25 bp, mus musculus
tttctacctgtgtgttaccatttag

SEQ ID NO: 108779 - DNA, 25 bp, mus musculus
gaataaagacacactcaacctttat

SEQ ID NO: 108780 - DNA, 25 bp, mus musculus
tgcggcgttcactgtaaggagtcgt

SEQ ID NO: 108781 - DNA, 25 bp, mus musculus
tagagggcacctggttgccatcagc

SEQ ID NO: 108782 - DNA, 25 bp, mus musculus
gcacctggttgccatcagcagggta

SEQ ID NO: 108783 - DNA, 25 bp, mus musculus
ggttgccatcagcagggtactggct

SEQ ID NO: 108784 - DNA, 25 bp, mus musculus
tttatacaatggcatctcagaaact

SEQ ID NO: 108785 - DNA, 25 bp, mus musculus
caatggcatctcagaaactctagca

SEQ ID NO: 108786 - DNA, 25 bp, mus musculus
catctcagaaactctagcaggtggg

SEQ ID NO: 108787 - DNA, 25 bp, mus musculus
gattttgatccctgggacttcatgg

SEQ ID NO: 108788 - DNA, 25 bp, mus musculus
ggaaattctgtggggccttggcacg

SEQ ID NO: 108789 - DNA, 25 bp, mus musculus
cttggcacgaaacccaccaacgcag

SEQ ID NO: 108790 - DNA, 25 bp, mus musculus
atcctgcaacacatatcctgaacaa

SEQ ID NO: 108791 - DNA, 25 bp, mus musculus
cctgcaacacatatcctgaacaagg

SEQ ID NO: 108792 - DNA, 25 bp, mus musculus
tgcaacacatatcctgaacaaggag

SEQ ID NO: 108793 - DNA, 25 bp, mus musculus
acacatatcctgaacaaggagcagg

SEQ ID NO: 108794 - DNA, 25 bp, mus musculus
acatatcctgaacaaggagcaggga

SEQ ID NO: 108795 - DNA, 25 bp, mus musculus
atatcctgaacaaggagcagggagc

SEQ ID NO: 108796 - DNA, 25 bp, mus musculus
atcctgaacaaggagcagggagcta

SEQ ID NO: 108797 - DNA, 25 bp, mus musculus
ctattaagacttcgtcgaggggctg

SEQ ID NO: 108798 - DNA, 25 bp, mus musculus
cgtcgaggggctgcggtctttgata

SEQ ID NO: 108799 - DNA, 25 bp, mus musculus
tcgaggggctgcggtctttgataag

SEQ ID NO: 108800 - DNA, 25 bp, mus musculus
tggcacgaaacccaccaacgcagag

SEQ ID NO: 108801 - DNA, 25 bp, mus musculus
ttttggcaaacccagactgtagaga

SEQ ID NO: 108802 - DNA, 25 bp, mus musculus
ttggcaaacccagactgtagagatg

SEQ ID NO: 108803 - DNA, 25 bp, mus musculus
ggcaaacccagactgtagagatgag

SEQ ID NO: 108804 - DNA, 25 bp, mus musculus
caaacccagactgtagagatgagtt

SEQ ID NO: 108805 - DNA, 25 bp, mus musculus
tctaaacactggagttctagatgtt

SEQ ID NO: 108806 - DNA, 25 bp, mus musculus
agttctagatgtttctgcgcatcct

SEQ ID NO: 108807 - DNA, 25 bp, mus musculus
gcatcctgcaacacatatcctgaac

SEQ ID NO: 108808 - DNA, 25 bp, mus musculus
gaggtcttcaacaacaagttccaca

SEQ ID NO: 108809 - DNA, 25 bp, mus musculus
ttcaacaacaagttccacatcattg

SEQ ID NO: 108810 - DNA, 25 bp, mus musculus
atgatcttcagcatgatcctgtgct

SEQ ID NO: 108811 - DNA, 25 bp, mus musculus
atgatcctgtgctgcgccatccgca

SEQ ID NO: 108812 - DNA, 25 bp, mus musculus
ctgtgctgcgccatccgcaggagcc

SEQ ID NO: 108813 - DNA, 25 bp, mus musculus
gaacaacggccctgaagactgtccg

SEQ ID NO: 108814 - DNA, 25 bp, mus musculus
taaataacagtcattctgtttgtcc

SEQ ID NO: 108815 - DNA, 25 bp, mus musculus
ataacagtcattctgtttgtccttt

SEQ ID NO: 108816 - DNA, 25 bp, mus musculus
aaatcctgcaatgaaaggtactata

SEQ ID NO: 108817 - DNA, 25 bp, mus musculus
tatatttgccagactctagacataa

SEQ ID NO: 108818 - DNA, 25 bp, mus musculus
atttgccagactctagacataagat

SEQ ID NO: 108819 - DNA, 25 bp, mus musculus
tgccagactctagacataagatatt

SEQ ID NO: 108820 - DNA, 25 bp, mus musculus
ttccacatcattggagcagtgggta

SEQ ID NO: 108821 - DNA, 25 bp, mus musculus
cacatcattggagcagtgggtatcg

SEQ ID NO: 108822 - DNA, 25 bp, mus musculus
atcattggagcagtgggtatcggca

SEQ ID NO: 108823 - DNA, 25 bp, mus musculus
atcggcatcgccgtggtgatgatct

SEQ ID NO: 108824 - DNA, 25 bp, mus musculus
ggcatcgccgtggtgatgatcttcg

SEQ ID NO: 108825 - DNA, 25 bp, mus musculus
atcgccgtggtgatgatcttcggca

SEQ ID NO: 108826 - DNA, 25 bp, mus musculus
atgatcttcggcatgatcttcagca

SEQ ID NO: 108827 - DNA, 25 bp, mus musculus
ttcggcatgatcttcagcatgatcc

SEQ ID NO: 108828 - DNA, 25 bp, mus musculus
gctgctggcattgccatggaagcca

SEQ ID NO: 108829 - DNA, 25 bp, mus musculus
ggcattgccatggaagccattgcct

SEQ ID NO: 108830 - DNA, 25 bp, mus musculus
gctggccgcatgcaagacaatgccc

SEQ ID NO: 108831 - DNA, 25 bp, mus musculus
aatgcccctctgatgactgccctgg

SEQ ID NO: 108832 - DNA, 25 bp, mus musculus
cctctgatgactgccctggccaaac

SEQ ID NO: 108833 - DNA, 25 bp, mus musculus
atgactgccctggccaaactcatta

SEQ ID NO: 108834 - DNA, 25 bp, mus musculus
gccctggccaaactcattactgtca

SEQ ID NO: 108835 - DNA, 25 bp, mus musculus
ctggccaaactcattactgtcaata

SEQ ID NO: 108836 - DNA, 25 bp, mus musculus
attactgtcaatacacctgacttgg

SEQ ID NO: 108837 - DNA, 25 bp, mus musculus
actgtcaatacacctgacttggtgc

SEQ ID NO: 108838 - DNA, 25 bp, mus musculus
aatacacctgacttggtgctgtttg

SEQ ID NO: 108839 - DNA, 25 bp, mus musculus
acacctgacttggtgctgtttgtag

SEQ ID NO: 108840 - DNA, 25 bp, mus musculus
gccatggaagccattgcctttgcac

SEQ ID NO: 108841 - DNA, 25 bp, mus musculus
atggaagccattgcctttgcacgta

SEQ ID NO: 108842 - DNA, 25 bp, mus musculus
gaagccattgcctttgcacgtaacc

SEQ ID NO: 108843 - DNA, 25 bp, mus musculus
cgtaaccaaggctttgatgtggtgc

SEQ ID NO: 108844 - DNA, 25 bp, mus musculus
tttgatgtggtgctggtagacactg

SEQ ID NO: 108845 - DNA, 25 bp, mus musculus
ctggtagacactgctggccgcatgc

SEQ ID NO: 108846 - DNA, 25 bp, mus musculus
gtagacactgctggccgcatgcaag

SEQ ID NO: 108847 - DNA, 25 bp, mus musculus
gacactgctggccgcatgcaagaca

SEQ ID NO: 108848 - DNA, 25 bp, mus musculus
gtgactcttgctactgactccaacg

SEQ ID NO: 108849 - DNA, 25 bp, mus musculus
cttgctactgactccaacgttaatg

SEQ ID NO: 108850 - DNA, 25 bp, mus musculus
agacctcagattccagaatggctca

SEQ ID NO: 108851 - DNA, 25 bp, mus musculus
ccagaatggctcatcatcttggcat

SEQ ID NO: 108852 - DNA, 25 bp, mus musculus
tggctcatcatcttggcatctctcc

SEQ ID NO: 108853 - DNA, 25 bp, mus musculus
ttggcatctctcctggcactggctc

SEQ ID NO: 108854 - DNA, 25 bp, mus musculus
tctctcctggcactggctctgattc

SEQ ID NO: 108855 - DNA, 25 bp, mus musculus
cttgccgtctgcatcgcggtcaata

SEQ ID NO: 108856 - DNA, 25 bp, mus musculus
gtctgcatcgcggtcaatagtagga

SEQ ID NO: 108857 - DNA, 25 bp, mus musculus
tcagagaccccagaccagtgtatga

SEQ ID NO: 108858 - DNA, 25 bp, mus musculus
accccagaccagtgtatgacagctg

SEQ ID NO: 108859 - DNA, 25 bp, mus musculus
acagctgacgagacccggaatctgc

SEQ ID NO: 108860 - DNA, 25 bp, mus musculus
gttgatggctccttaccaggagatc

SEQ ID NO: 108861 - DNA, 25 bp, mus musculus
tgtagtgccctacgccattgaattc

SEQ ID NO: 108862 - DNA, 25 bp, mus musculus
ggctccttaccaggagatcgagact

SEQ ID NO: 108863 - DNA, 25 bp, mus musculus
tcccgcactgtgactcatggatccg

SEQ ID NO: 108864 - DNA, 25 bp, mus musculus
actgtgactcatggatccgaattag

SEQ ID NO: 108865 - DNA, 25 bp, mus musculus
gctggacactcaagtgcgaaccagg

SEQ ID NO: 108866 - DNA, 25 bp, mus musculus
cactcaagtgcgaaccaggacagtg

SEQ ID NO: 108867 - DNA, 25 bp, mus musculus
agtgcgaaccaggacagtggagtga

SEQ ID NO: 108868 - DNA, 25 bp, mus musculus
acttctggtcctatgaggagacctc

SEQ ID NO: 108869 - DNA, 25 bp, mus musculus
gctcgttactccactccggttgaca

SEQ ID NO: 108870 - DNA, 25 bp, mus musculus
tactccactccggttgacatctgga

SEQ ID NO: 108871 - DNA, 25 bp, mus musculus
ttcctctcaaaaatgctagtctatg

SEQ ID NO: 108872 - DNA, 25 bp, mus musculus
atgctagtctatgatcctgccaaac

SEQ ID NO: 108873 - DNA, 25 bp, mus musculus
gtctatgatcctgccaaacgaatct

SEQ ID NO: 108874 - DNA, 25 bp, mus musculus
gatcctgccaaacgaatctctggca

SEQ ID NO: 108875 - DNA, 25 bp, mus musculus
gccaaacgaatctctggcaaaatgg

SEQ ID NO: 108876 - DNA, 25 bp, mus musculus
gccctgaagcacccgtactttgatg

SEQ ID NO: 108877 - DNA, 25 bp, mus musculus
aagcacccgtactttgatgacttgg

SEQ ID NO: 108878 - DNA, 25 bp, mus musculus
ttgtttaccgttggctctcttcctg

SEQ ID NO: 108879 - DNA, 25 bp, mus musculus
accgttggctctcttcctgtcttgt

SEQ ID NO: 108880 - DNA, 25 bp, mus musculus
taaactgtcatctggacttttctta

SEQ ID NO: 108881 - DNA, 25 bp, mus musculus
actccggttgacatctggagtatag

SEQ ID NO: 108882 - DNA, 25 bp, mus musculus
ttcagagctcttgggactcctaaca

SEQ ID NO: 108883 - DNA, 25 bp, mus musculus
gctcttgggactcctaacaacgaag

SEQ ID NO: 108884 - DNA, 25 bp, mus musculus
ccagaagtcgagtccctgcaggact

SEQ ID NO: 108885 - DNA, 25 bp, mus musculus
tccctgcaggactacaagaacacct

SEQ ID NO: 108886 - DNA, 25 bp, mus musculus
ctcgcatcccacgtcaagaacctgg

SEQ ID NO: 108887 - DNA, 25 bp, mus musculus
tcccacgtcaagaacctggacgaga

SEQ ID NO: 108888 - DNA, 25 bp, mus musculus
ttggatttcctctcaaaaatgctag

SEQ ID NO: 108889 - DNA, 25 bp, mus musculus
gtgcccaccgttcttaggcatcagc

SEQ ID NO: 108890 - DNA, 25 bp, mus musculus
cccaccgttcttaggcatcagcatg

SEQ ID NO: 108891 - DNA, 25 bp, mus musculus
cgggatccactgttcggcagagaaa

SEQ ID NO: 108892 - DNA, 25 bp, mus musculus
gggatccactgttcggcagagaaaa

SEQ ID NO: 108893 - DNA, 25 bp, mus musculus
aaatgccagctgtgggacccggagc

SEQ ID NO: 108894 - DNA, 25 bp, mus musculus
tctacacggaagattccccagggct

SEQ ID NO: 108895 - DNA, 25 bp, mus musculus
ggaagattccccagggctcaaagtg

SEQ ID NO: 108896 - DNA, 25 bp, mus musculus
tcaaagtgggccctgtcccagtgct

SEQ ID NO: 108897 - DNA, 25 bp, mus musculus
caaagtgggccctgtcccagtgctg

SEQ ID NO: 108898 - DNA, 25 bp, mus musculus
tgtcccagtgctggtgatgagtctt

SEQ ID NO: 108899 - DNA, 25 bp, mus musculus
gatgagtcttctgttcatcgctgct

SEQ ID NO: 108900 - DNA, 25 bp, mus musculus
tgagtcttctgttcatcgctgctgt

SEQ ID NO: 108901 - DNA, 25 bp, mus musculus
tcttaggcatcagcatgccgggtcc

SEQ ID NO: 108902 - DNA, 25 bp, mus musculus
gagtcttctgttcatcgctgctgta

SEQ ID NO: 108903 - DNA, 25 bp, mus musculus
caacgcccagtggcaccaacgtggg

SEQ ID NO: 108904 - DNA, 25 bp, mus musculus
ccagtggcaccaacgtgggctcctc

SEQ ID NO: 108905 - DNA, 25 bp, mus musculus
tggcaccaacgtgggctcctctggc

SEQ ID NO: 108906 - DNA, 25 bp, mus musculus
gctctcccagcaaagcggtggccgc

SEQ ID NO: 108907 - DNA, 25 bp, mus musculus
ctctcccagcaaagcggtggccgca

SEQ ID NO: 108908 - DNA, 25 bp, mus musculus
ctcccagcaaagcggtggccgcacg

SEQ ID NO: 108909 - DNA, 25 bp, mus musculus
ccagcaaagcggtggccgcacgggc

SEQ ID NO: 108910 - DNA, 25 bp, mus musculus
gcatgtatttaacccacagaatgct

SEQ ID NO: 108911 - DNA, 25 bp, mus musculus
gaatgcttactgtgtgtcgggcgcg

SEQ ID NO: 108912 - DNA, 25 bp, mus musculus
ccaggctctctactgggcgttaggg

SEQ ID NO: 108913 - DNA, 25 bp, mus musculus
tccttcaaggattgctcagagattc

SEQ ID NO: 108914 - DNA, 25 bp, mus musculus
taaatctgctgaaaccagaccccag

SEQ ID NO: 108915 - DNA, 25 bp, mus musculus
tgctgaaaccagaccccagactcct

SEQ ID NO: 108916 - DNA, 25 bp, mus musculus
tcccgagagtccaactcactcactg

SEQ ID NO: 108917 - DNA, 25 bp, mus musculus
ctcactgtggttgctggcagctgca

SEQ ID NO: 108918 - DNA, 25 bp, mus musculus
agctgcagcatgcgtatacagcatg

SEQ ID NO: 108919 - DNA, 25 bp, mus musculus
ctgtgcgttatggttcaggtcagac

SEQ ID NO: 108920 - DNA, 25 bp, mus musculus
ctgtgtcctcccaggtgagatgacc

SEQ ID NO: 108921 - DNA, 25 bp, mus musculus
gatgacccctcagctggaactgatc

SEQ ID NO: 108922 - DNA, 25 bp, mus musculus
tgcccctactggaaggtattatgta

SEQ ID NO: 108923 - DNA, 25 bp, mus musculus
ttctctcttacattggagaacacca

SEQ ID NO: 108924 - DNA, 25 bp, mus musculus
ttggagaacaccaccgagctatcca

SEQ ID NO: 108925 - DNA, 25 bp, mus musculus
accgagctatccactcatcaaacat

SEQ ID NO: 108926 - DNA, 25 bp, mus musculus
ctatccactcatcaaacatttattg

SEQ ID NO: 108927 - DNA, 25 bp, mus musculus
actcatcaaacatttattgagagca

SEQ ID NO: 108928 - DNA, 25 bp, mus musculus
gagagcatccctagggagccaggct

SEQ ID NO: 108929 - DNA, 25 bp, mus musculus
atccctagggagccaggctctctac

SEQ ID NO: 108930 - DNA, 25 bp, mus musculus
gtcatcattgtgttcctctgtgaat

SEQ ID NO: 108931 - DNA, 25 bp, mus musculus
attgtgttcctctgtgaattctcct

SEQ ID NO: 108932 - DNA, 25 bp, mus musculus
gcgagcccacaatagtgactatgac

SEQ ID NO: 108933 - DNA, 25 bp, mus musculus
aatacactacagaccctggacagaa

SEQ ID NO: 108934 - DNA, 25 bp, mus musculus
ctacagaccctggacagaaggagtc

SEQ ID NO: 108935 - DNA, 25 bp, mus musculus
aggagtcatcttccatgtcgctaat

SEQ ID NO: 108936 - DNA, 25 bp, mus musculus
catcttccatgtcgctaatcccgtg

SEQ ID NO: 108937 - DNA, 25 bp, mus musculus
cgctaatcccgtgattatgtctgca

SEQ ID NO: 108938 - DNA, 25 bp, mus musculus
gattatgtctgcaaacatgggcaga

SEQ ID NO: 108939 - DNA, 25 bp, mus musculus
gtctgcaaacatgggcagagccagg

SEQ ID NO: 108940 - DNA, 25 bp, mus musculus
taaatgcctttcgtcctagcactaa

SEQ ID NO: 108941 - DNA, 25 bp, mus musculus
cagcctggtctacatgtgaccttgt

SEQ ID NO: 108942 - DNA, 25 bp, mus musculus
ttcctctgtgaattctcctccgaga

SEQ ID NO: 108943 - DNA, 25 bp, mus musculus
tgtgaattctcctccgagagaggcc

SEQ ID NO: 108944 - DNA, 25 bp, mus musculus
gacagggctctgaaccagtatccgg

SEQ ID NO: 108945 - DNA, 25 bp, mus musculus
tattaccctgagctatatatcctca

SEQ ID NO: 108946 - DNA, 25 bp, mus musculus
agagatttctttccagagtatatgg

SEQ ID NO: 108947 - DNA, 25 bp, mus musculus
tgtgacccacagagctactgtccca

SEQ ID NO: 108948 - DNA, 25 bp, mus musculus
atgcttcaccaggaccaccaggctg

SEQ ID NO: 108949 - DNA, 25 bp, mus musculus
cagattgccctcctggtgaagggtg

SEQ ID NO: 108950 - DNA, 25 bp, mus musculus
ccatccactgtggatagtgattata

SEQ ID NO: 108951 - DNA, 25 bp, mus musculus
agtgattatagtccagcccaagtgc

SEQ ID NO: 108952 - DNA, 25 bp, mus musculus
ctttatcaatgttctcattgagaat

SEQ ID NO: 108953 - DNA, 25 bp, mus musculus
tatcaatgttctcattgagaataac

SEQ ID NO: 108954 - DNA, 25 bp, mus musculus
gaataacgtcagcgtgtcgaatcgc

SEQ ID NO: 108955 - DNA, 25 bp, mus musculus
taacgtcagcgtgtcgaatcgctac

SEQ ID NO: 108956 - DNA, 25 bp, mus musculus
cagcgtgtcgaatcgctacggtccc

SEQ ID NO: 108957 - DNA, 25 bp, mus musculus
cgtgtcgaatcgctacggtcccagg

SEQ ID NO: 108958 - DNA, 25 bp, mus musculus
gtcgaatcgctacggtcccaggagt

SEQ ID NO: 108959 - DNA, 25 bp, mus musculus
gaatcgctacggtcccaggagtatt

SEQ ID NO: 108960 - DNA, 25 bp, mus musculus
tcgctacggtcccaggagtattcca

SEQ ID NO: 108961 - DNA, 25 bp, mus musculus
tcccaggagtattccagttgatata

SEQ ID NO: 108962 - DNA, 25 bp, mus musculus
gattatagtccagcccaagtgcatg

SEQ ID NO: 108963 - DNA, 25 bp, mus musculus
tatagtccagcccaagtgcatgggc

SEQ ID NO: 108964 - DNA, 25 bp, mus musculus
agtccagcccaagtgcatgggcatg

SEQ ID NO: 108965 - DNA, 25 bp, mus musculus
ccagcccaagtgcatgggcatgctt

SEQ ID NO: 108966 - DNA, 25 bp, mus musculus
caagtgcatgggcatgcttggaaac

SEQ ID NO: 108967 - DNA, 25 bp, mus musculus
gcttggaaacgccatcatagtgaac

SEQ ID NO: 108968 - DNA, 25 bp, mus musculus
tggaaacgccatcatagtgaacttt

SEQ ID NO: 108969 - DNA, 25 bp, mus musculus
aaacgccatcatagtgaactttatc

SEQ ID NO: 108970 - DNA, 25 bp, mus musculus
cgcaaaggccggctacactgaccag

SEQ ID NO: 108971 - DNA, 25 bp, mus musculus
cggctacactgaccaggttgtcatt

SEQ ID NO: 108972 - DNA, 25 bp, mus musculus
tcccgaccagctggctgatctgtac

SEQ ID NO: 108973 - DNA, 25 bp, mus musculus
ccagctggctgatctgtacaagtcc

SEQ ID NO: 108974 - DNA, 25 bp, mus musculus
cttcgtccagaactacccagtggtg

SEQ ID NO: 108975 - DNA, 25 bp, mus musculus
ctacccagtggtgtccatcgaagat

SEQ ID NO: 108976 - DNA, 25 bp, mus musculus
cccagtggtgtccatcgaagatccc

SEQ ID NO: 108977 - DNA, 25 bp, mus musculus
gtccatcgaagatccctttgaccag

SEQ ID NO: 108978 - DNA, 25 bp, mus musculus
cgcctggcagaagttcacggctagt

SEQ ID NO: 108979 - DNA, 25 bp, mus musculus
gttcacggctagtgcgggcatccag

SEQ ID NO: 108980 - DNA, 25 bp, mus musculus
cctcacagtgaccaaccctaagcgg

SEQ ID NO: 108981 - DNA, 25 bp, mus musculus
cacagtgaccaaccctaagcggatt

SEQ ID NO: 108982 - DNA, 25 bp, mus musculus
cactgaccaggttgtcattggcatg

SEQ ID NO: 108983 - DNA, 25 bp, mus musculus
ccaggttgtcattggcatggatgtg

SEQ ID NO: 108984 - DNA, 25 bp, mus musculus
ggttgtcattggcatggatgtggct

SEQ ID NO: 108985 - DNA, 25 bp, mus musculus
tgcctccgagttctacaggtctggc

SEQ ID NO: 108986 - DNA, 25 bp, mus musculus
ctccgagttctacaggtctggcaag

SEQ ID NO: 108987 - DNA, 25 bp, mus musculus
gttctacaggtctggcaagtatgac

SEQ ID NO: 108988 - DNA, 25 bp, mus musculus
ctacaggtctggcaagtatgacctg

SEQ ID NO: 108989 - DNA, 25 bp, mus musculus
gtctccggatgaccccagcaggtac

SEQ ID NO: 108990 - DNA, 25 bp, mus musculus
ccttgcaaagtgccacagttgaggc

SEQ ID NO: 108991 - DNA, 25 bp, mus musculus
cttcccagggactctcacatcttgg

SEQ ID NO: 108992 - DNA, 25 bp, mus musculus
aaaccattgtgctttctgagatccg

SEQ ID NO: 108993 - DNA, 25 bp, mus musculus
ccattgtgctttctgagatccgtgc

SEQ ID NO: 108994 - DNA, 25 bp, mus musculus
tcctggatggaggcttgagggccct

SEQ ID NO: 108995 - DNA, 25 bp, mus musculus
ccctgggacttgtgccgtctataag

SEQ ID NO: 108996 - DNA, 25 bp, mus musculus
tgggacttgtgccgtctataagatt

SEQ ID NO: 108997 - DNA, 25 bp, mus musculus
gacttgtgccgtctataagattggg

SEQ ID NO: 108998 - DNA, 25 bp, mus musculus
ttgtgccgtctataagattgggtaa

SEQ ID NO: 108999 - DNA, 25 bp, mus musculus
tgggtaatcgctgccacagaggaga

SEQ ID NO: 109000 - DNA, 25 bp, mus musculus
gtaatcgctgccacagaggagagca

SEQ ID NO: 109001 - DNA, 25 bp, mus musculus
atcgctgccacagaggagagcagtg

SEQ ID NO: 109002 - DNA, 25 bp, mus musculus
agggactctcacatcttgggcccca

SEQ ID NO: 109003 - DNA, 25 bp, mus musculus
cacatcttgggccccaaatggacag

SEQ ID NO: 109004 - DNA, 25 bp, mus musculus
ttgggccccaaatggacagatcact

SEQ ID NO: 109005 - DNA, 25 bp, mus musculus
tggacagatcacttcaaggagctgg

SEQ ID NO: 109006 - DNA, 25 bp, mus musculus
acagatcacttcaaggagctggagg

SEQ ID NO: 109007 - DNA, 25 bp, mus musculus
aatgtcataatctctctgaagaaac

SEQ ID NO: 109008 - DNA, 25 bp, mus musculus
ataatctctctgaagaaaccattgt

SEQ ID NO: 109009 - DNA, 25 bp, mus musculus
atctctctgaagaaaccattgtgct

SEQ ID NO: 109010 - DNA, 25 bp, mus musculus
gattcaccgccatttcgtacaaagt

SEQ ID NO: 109011 - DNA, 25 bp, mus musculus
accatcaattatcccacttgtgtat

SEQ ID NO: 109012 - DNA, 25 bp, mus musculus
tgtaagttcttcaacatctgtttct

SEQ ID NO: 109013 - DNA, 25 bp, mus musculus
taagttcttcaacatctgtttctat

SEQ ID NO: 109014 - DNA, 25 bp, mus musculus
agttcttcaacatctgtttctattc

SEQ ID NO: 109015 - DNA, 25 bp, mus musculus
tcaacatctgtttctattcagaact

SEQ ID NO: 109016 - DNA, 25 bp, mus musculus
aacatctgtttctattcagaacttt

SEQ ID NO: 109017 - DNA, 25 bp, mus musculus
catctgtttctattcagaactttct

SEQ ID NO: 109018 - DNA, 25 bp, mus musculus
attaatatgatttcccaaagcatgt

SEQ ID NO: 109019 - DNA, 25 bp, mus musculus
atatgatttcccaaagcatgtaaca

SEQ ID NO: 109020 - DNA, 25 bp, mus musculus
atgatttcccaaagcatgtaacaac

SEQ ID NO: 109021 - DNA, 25 bp, mus musculus
gatttcccaaagcatgtaacaacca

SEQ ID NO: 109022 - DNA, 25 bp, mus musculus
atcccacttgtgtataaaatcataa

SEQ ID NO: 109023 - DNA, 25 bp, mus musculus
gactaatatactttcaatttgcatt

SEQ ID NO: 109024 - DNA, 25 bp, mus musculus
ctaatatactttcaatttgcattga

SEQ ID NO: 109025 - DNA, 25 bp, mus musculus
aatatactttcaatttgcattgaag

SEQ ID NO: 109026 - DNA, 25 bp, mus musculus
ctttcaatttgcattgaagtattgt

SEQ ID NO: 109027 - DNA, 25 bp, mus musculus
attgtttaactcatgtcttctcata

SEQ ID NO: 109028 - DNA, 25 bp, mus musculus
tgtttaactcatgtcttctcataaa

SEQ ID NO: 109029 - DNA, 25 bp, mus musculus
caaactatttcaatcaagaaagtag

SEQ ID NO: 109030 - DNA, 25 bp, mus musculus
gaatattactgctacagtttcaact

SEQ ID NO: 109031 - DNA, 25 bp, mus musculus
aatattactgctacagtttcaactt

SEQ ID NO: 109032 - DNA, 25 bp, mus musculus
gaagtatcaactcatttcttctcat

SEQ ID NO: 109033 - DNA, 25 bp, mus musculus
aagtatcaactcatttcttctcata

SEQ ID NO: 109034 - DNA, 25 bp, mus musculus
gtatcaactcatttcttctcataaa

SEQ ID NO: 109035 - DNA, 25 bp, mus musculus
tatcaactcatttcttctcataaat

SEQ ID NO: 109036 - DNA, 25 bp, mus musculus
tattgactcattcttcaaatttagt

SEQ ID NO: 109037 - DNA, 25 bp, mus musculus
ttgactcattcttcaaatttagtat

SEQ ID NO: 109038 - DNA, 25 bp, mus musculus
tgactcattcttcaaatttagtatt

SEQ ID NO: 109039 - DNA, 25 bp, mus musculus
gactcattcttcaaatttagtatta

SEQ ID NO: 109040 - DNA, 25 bp, mus musculus
tattatttctgaatcatgtaacaac

SEQ ID NO: 109041 - DNA, 25 bp, mus musculus
aaactatctaatactttcatatcaa

SEQ ID NO: 109042 - DNA, 25 bp, mus musculus
tattactgctacagtttcaacttcc

SEQ ID NO: 109043 - DNA, 25 bp, mus musculus
aactatctaatactttcatatcaat

SEQ ID NO: 109044 - DNA, 25 bp, mus musculus
ctgctacagtttcaacttccatttg

SEQ ID NO: 109045 - DNA, 25 bp, mus musculus
tgctacagtttcaacttccatttga

SEQ ID NO: 109046 - DNA, 25 bp, mus musculus
gtttcaacttccatttgaagtatca

SEQ ID NO: 109047 - DNA, 25 bp, mus musculus
tcaacttccatttgaagtatcaact

SEQ ID NO: 109048 - DNA, 25 bp, mus musculus
caacttccatttgaagtatcaactc

SEQ ID NO: 109049 - DNA, 25 bp, mus musculus
aacttccatttgaagtatcaactca

SEQ ID NO: 109050 - DNA, 25 bp, mus musculus
tgaagtatcaactcatttcttctca

SEQ ID NO: 109051 - DNA, 25 bp, mus musculus
ctgacagagtactcccgaacactga

SEQ ID NO: 109052 - DNA, 25 bp, mus musculus
gagtactcccgaacactgagtggta

SEQ ID NO: 109053 - DNA, 25 bp, mus musculus
ctaagaaaccgccatgcccaaggag

SEQ ID NO: 109054 - DNA, 25 bp, mus musculus
atctccaacattttggaggaaatgg

SEQ ID NO: 109055 - DNA, 25 bp, mus musculus
cagcctctgttggtgtcagtcagtg

SEQ ID NO: 109056 - DNA, 25 bp, mus musculus
gtcagtgctttgaccttagcaactg

SEQ ID NO: 109057 - DNA, 25 bp, mus musculus
gctttgaccttagcaactgaaactg

SEQ ID NO: 109058 - DNA, 25 bp, mus musculus
accttagcaactgaaactgtgcgga

SEQ ID NO: 109059 - DNA, 25 bp, mus musculus
gcaactgaaactgtgcggagcattc

SEQ ID NO: 109060 - DNA, 25 bp, mus musculus
gtaaatactcgataatctggataaa

SEQ ID NO: 109061 - DNA, 25 bp, mus musculus
cattgtcttccagttggcatttgtt

SEQ ID NO: 109062 - DNA, 25 bp, mus musculus
cttccagttggcatttgtttgaaat

SEQ ID NO: 109063 - DNA, 25 bp, mus musculus
tcccgaacactgagtggtatggagt

SEQ ID NO: 109064 - DNA, 25 bp, mus musculus
atggagtcctactgtgttcgtgctt

SEQ ID NO: 109065 - DNA, 25 bp, mus musculus
tcctactgtgttcgtgctttcgcgg

SEQ ID NO: 109066 - DNA, 25 bp, mus musculus
tgtgttcgtgctttcgcggatgcta

SEQ ID NO: 109067 - DNA, 25 bp, mus musculus
cgtgctttcgcggatgctatggaag

SEQ ID NO: 109068 - DNA, 25 bp, mus musculus
ccatctacactagctgaaaatgctg

SEQ ID NO: 109069 - DNA, 25 bp, mus musculus
aatgctggcctgaatcccatttcta

SEQ ID NO: 109070 - DNA, 25 bp, mus musculus
aatcccatttctacagtaacagagc

SEQ ID NO: 109071 - DNA, 25 bp, mus musculus
aacctctttgctgcattatccatag

SEQ ID NO: 109072 - DNA, 25 bp, mus musculus
tttgctgcattatccatagataatg

SEQ ID NO: 109073 - DNA, 25 bp, mus musculus
gtccagactgtacaccagaagatgg

SEQ ID NO: 109074 - DNA, 25 bp, mus musculus
actgtacaccagaagatggtgtggt

SEQ ID NO: 109075 - DNA, 25 bp, mus musculus
gtcagcccgctggaaagcagacact

SEQ ID NO: 109076 - DNA, 25 bp, mus musculus
attagctgttgattctcaaagcagg

SEQ ID NO: 109077 - DNA, 25 bp, mus musculus
tgttgattctcaaagcagggaccca

SEQ ID NO: 109078 - DNA, 25 bp, mus musculus
ttctcaaagcagggacccatggaag

SEQ ID NO: 109079 - DNA, 25 bp, mus musculus
ctccttccaactttgaatctgacaa

SEQ ID NO: 109080 - DNA, 25 bp, mus musculus
ttgaatctgacaactcctagaaaaa

SEQ ID NO: 109081 - DNA, 25 bp, mus musculus
ctgacaactcctagaaaaagatgac

SEQ ID NO: 109082 - DNA, 25 bp, mus musculus
agatgacctttgcttgtgcatattt

SEQ ID NO: 109083 - DNA, 25 bp, mus musculus
cagctgagtgcccccaatatactag

SEQ ID NO: 109084 - DNA, 25 bp, mus musculus
aagctgtgtcccctgtctgatttgt

SEQ ID NO: 109085 - DNA, 25 bp, mus musculus
tgtcccctgtctgatttgtaggaat

SEQ ID NO: 109086 - DNA, 25 bp, mus musculus
tagataccctgcatgctatcattgg

SEQ ID NO: 109087 - DNA, 25 bp, mus musculus
ccctgcatgctatcattggctcata

SEQ ID NO: 109088 - DNA, 25 bp, mus musculus
atgctatcattggctcatactctct

SEQ ID NO: 109089 - DNA, 25 bp, mus musculus
ggcaacacacaagtccagactgtac

SEQ ID NO: 109090 - DNA, 25 bp, mus musculus
acacaagtccagactgtacaccaga

SEQ ID NO: 109091 - DNA, 25 bp, mus musculus
aagttcactgtcattagaccatttc

SEQ ID NO: 109092 - DNA, 25 bp, mus musculus
ttcactgtcattagaccatttccag

SEQ ID NO: 109093 - DNA, 25 bp, mus musculus
gaatcagccgaggcaagccagttgg

SEQ ID NO: 109094 - DNA, 25 bp, mus musculus
agttcacagatcaagcaggagccag

SEQ ID NO: 109095 - DNA, 25 bp, mus musculus
acgtggtagaccgtggctctccagg

SEQ ID NO: 109096 - DNA, 25 bp, mus musculus
accgtggctctccaggttcgtccag

SEQ ID NO: 109097 - DNA, 25 bp, mus musculus
gctctccaggttcgtccagtgtcca

SEQ ID NO: 109098 - DNA, 25 bp, mus musculus
ctccaggttcgtccagtgtccagcg

SEQ ID NO: 109099 - DNA, 25 bp, mus musculus
ccgtttctgccagctctgtaatata

SEQ ID NO: 109100 - DNA, 25 bp, mus musculus
tttctgccagctctgtaatatactt

SEQ ID NO: 109101 - DNA, 25 bp, mus musculus
ctgccagctctgtaatatacttgta

SEQ ID NO: 109102 - DNA, 25 bp, mus musculus
ccagctctgtaatatacttgtataa

SEQ ID NO: 109103 - DNA, 25 bp, mus musculus
gtcattagaccatttccaggacttg

SEQ ID NO: 109104 - DNA, 25 bp, mus musculus
attagaccatttccaggacttgtga

SEQ ID NO: 109105 - DNA, 25 bp, mus musculus
agaccatttccaggacttgtgatta

SEQ ID NO: 109106 - DNA, 25 bp, mus musculus
ccatttccaggacttgtgattaata

SEQ ID NO: 109107 - DNA, 25 bp, mus musculus
aaccagctggttgatcagaacgagt

SEQ ID NO: 109108 - DNA, 25 bp, mus musculus
aacgagtctgaaggccctgtgatac

SEQ ID NO: 109109 - DNA, 25 bp, mus musculus
gagtctgaaggccctgtgatacaag

SEQ ID NO: 109110 - DNA, 25 bp, mus musculus
caagaatcagccgaggcaagccagt

SEQ ID NO: 109111 - DNA, 25 bp, mus musculus
gacatcaactgatgtcatgaagcga

SEQ ID NO: 109112 - DNA, 25 bp, mus musculus
acccctgttgccctgttcatcaatc

SEQ ID NO: 109113 - DNA, 25 bp, mus musculus
agtccaaccaaatcctcctctatag

SEQ ID NO: 109114 - DNA, 25 bp, mus musculus
gaagcctgccactgtcaatcaaggc

SEQ ID NO: 109115 - DNA, 25 bp, mus musculus
tgccactgtcaatcaaggccgccca

SEQ ID NO: 109116 - DNA, 25 bp, mus musculus
ctcctgcctcagttccagggatggc

SEQ ID NO: 109117 - DNA, 25 bp, mus musculus
cctcagttccagggatggcagggac

SEQ ID NO: 109118 - DNA, 25 bp, mus musculus
attttaccttaacagccagcacaca

SEQ ID NO: 109119 - DNA, 25 bp, mus musculus
acacacacacagacacaaactgtca

SEQ ID NO: 109120 - DNA, 25 bp, mus musculus
actgtcataaaatccaacgtgcctt

SEQ ID NO: 109121 - DNA, 25 bp, mus musculus
tccaacgtgccttcatgatcaaagt

SEQ ID NO: 109122 - DNA, 25 bp, mus musculus
gtgccttcatgatcaaagttcgata

SEQ ID NO: 109123 - DNA, 25 bp, mus musculus
gttgccctgttcatcaatcaccaaa

SEQ ID NO: 109124 - DNA, 25 bp, mus musculus
ctgttcatcaatcaccaaagtgggc

SEQ ID NO: 109125 - DNA, 25 bp, mus musculus
atcaatcaccaaagtgggcgtgtcc

SEQ ID NO: 109126 - DNA, 25 bp, mus musculus
caccaaagtgggcgtgtccagtctc

SEQ ID NO: 109127 - DNA, 25 bp, mus musculus
acattgatgtcaccgtgatatcaca

SEQ ID NO: 109128 - DNA, 25 bp, mus musculus
atgtcaccgtgatatcacagtccaa

SEQ ID NO: 109129 - DNA, 25 bp, mus musculus
ccgtgatatcacagtccaaccaaat

SEQ ID NO: 109130 - DNA, 25 bp, mus musculus
tatcacagtccaaccaaatcctcct

SEQ ID NO: 109131 - DNA, 25 bp, mus musculus
tgacttctcccgtgaaaagatggac

SEQ ID NO: 109132 - DNA, 25 bp, mus musculus
cttctcccgtgaaaagatggacctg

SEQ ID NO: 109133 - DNA, 25 bp, mus musculus
catcagcagacagccgaaggctgag

SEQ ID NO: 109134 - DNA, 25 bp, mus musculus
cagcagacagccgaaggctgaggaa

SEQ ID NO: 109135 - DNA, 25 bp, mus musculus
cagacagccgaaggctgaggaatca

SEQ ID NO: 109136 - DNA, 25 bp, mus musculus
atcaaaatgtcgtctttgagcctag

SEQ ID NO: 109137 - DNA, 25 bp, mus musculus
atgtcgtctttgagcctagtaccaa

SEQ ID NO: 109138 - DNA, 25 bp, mus musculus
tcgtctttgagcctagtaccaaaca

SEQ ID NO: 109139 - DNA, 25 bp, mus musculus
ttgagcctagtaccaaacagtaata

SEQ ID NO: 109140 - DNA, 25 bp, mus musculus
agcctagtaccaaacagtaataatg

SEQ ID NO: 109141 - DNA, 25 bp, mus musculus
ctagtaccaaacagtaataatgcta

SEQ ID NO: 109142 - DNA, 25 bp, mus musculus
aatgctacattcaaattgtgaacag

SEQ ID NO: 109143 - DNA, 25 bp, mus musculus
cgcttttgagtttctctcctctgcg

SEQ ID NO: 109144 - DNA, 25 bp, mus musculus
ttttgagtttctctcctctgcgtga

SEQ ID NO: 109145 - DNA, 25 bp, mus musculus
ctctgcgtgactagacactcgtttt

SEQ ID NO: 109146 - DNA, 25 bp, mus musculus
tgcgtgactagacactcgttttgac

SEQ ID NO: 109147 - DNA, 25 bp, mus musculus
actagacactcgttttgacatcagc

SEQ ID NO: 109148 - DNA, 25 bp, mus musculus
agacactcgttttgacatcagcaga

SEQ ID NO: 109149 - DNA, 25 bp, mus musculus
cactcgttttgacatcagcagacag

SEQ ID NO: 109150 - DNA, 25 bp, mus musculus
tgacatcagcagacagccgaaggct

SEQ ID NO: 109151 - DNA, 25 bp, mus musculus
tctgaaaccgcttattgaaacagaa

SEQ ID NO: 109152 - DNA, 25 bp, mus musculus
aacagaattttcagctctggaggaa

SEQ ID NO: 109153 - DNA, 25 bp, mus musculus
tcacaatggacaccgtgcgagggac

SEQ ID NO: 109154 - DNA, 25 bp, mus musculus
tggacaccgtgcgagggacctgaac

SEQ ID NO: 109155 - DNA, 25 bp, mus musculus
aacgtgtctgtgtcaggatctgttt

SEQ ID NO: 109156 - DNA, 25 bp, mus musculus
cgatgttcctttgatgtaatatcct

SEQ ID NO: 109157 - DNA, 25 bp, mus musculus
cttttcaggccacttgctctgttga

SEQ ID NO: 109158 - DNA, 25 bp, mus musculus
aggccacttgctctgttgaggaatc

SEQ ID NO: 109159 - DNA, 25 bp, mus musculus
caaatgtacccagggtcactgtgta

SEQ ID NO: 109160 - DNA, 25 bp, mus musculus
tacccagggtcactgtgtaccttgt

SEQ ID NO: 109161 - DNA, 25 bp, mus musculus
gggtcactgtgtaccttgtctttga

SEQ ID NO: 109162 - DNA, 25 bp, mus musculus
ctgtgtaccttgtctttgagataca

SEQ ID NO: 109163 - DNA, 25 bp, mus musculus
gctcacggagtctctacaggactga

SEQ ID NO: 109164 - DNA, 25 bp, mus musculus
ggagtctctacaggactgaaaagct

SEQ ID NO: 109165 - DNA, 25 bp, mus musculus
tggtcaacagccaaacccatgcacg

SEQ ID NO: 109166 - DNA, 25 bp, mus musculus
atgcacggtgtgtgatccttttgag

SEQ ID NO: 109167 - DNA, 25 bp, mus musculus
tgatccttttgagtgtttgaccaga

SEQ ID NO: 109168 - DNA, 25 bp, mus musculus
aatttctctacagtgaaaatgtgtg

SEQ ID NO: 109169 - DNA, 25 bp, mus musculus
agtatcatcttctcctgggattttt

SEQ ID NO: 109170 - DNA, 25 bp, mus musculus
atcttctcctgggatttttcacaat

SEQ ID NO: 109171 - DNA, 25 bp, mus musculus
ccgtcatctgcatcctgcttaacct

SEQ ID NO: 109172 - DNA, 25 bp, mus musculus
tctgcatcctgcttaaccttgtgga

SEQ ID NO: 109173 - DNA, 25 bp, mus musculus
tctcatgcgacctcatctttctggg

SEQ ID NO: 109174 - DNA, 25 bp, mus musculus
ctcgagcccacgtgaagaaaaccat

SEQ ID NO: 109175 - DNA, 25 bp, mus musculus
cagaatctctcatgaatgtagctga

SEQ ID NO: 109176 - DNA, 25 bp, mus musculus
tcccagagctttgggatccagttgt

SEQ ID NO: 109177 - DNA, 25 bp, mus musculus
agctttgggatccagttgtgcctcc

SEQ ID NO: 109178 - DNA, 25 bp, mus musculus
gactggccttcgctgagtcacccct

SEQ ID NO: 109179 - DNA, 25 bp, mus musculus
aacacaccgagggccacttcgcagg

SEQ ID NO: 109180 - DNA, 25 bp, mus musculus
ttcacgaaggcaccgatgagcaaat

SEQ ID NO: 109181 - DNA, 25 bp, mus musculus
agcaaatgccttcctgtgtggccca

SEQ ID NO: 109182 - DNA, 25 bp, mus musculus
cctgtgtggcccagggtgagagcta

SEQ ID NO: 109183 - DNA, 25 bp, mus musculus
ttaaccttgtggagctgatctacct

SEQ ID NO: 109184 - DNA, 25 bp, mus musculus
agctgatctacctagtgattaagcg

SEQ ID NO: 109185 - DNA, 25 bp, mus musculus
tctacctagtgattaagcggtgttc

SEQ ID NO: 109186 - DNA, 25 bp, mus musculus
ttaagcggtgttctgagtgtgcgca

SEQ ID NO: 109187 - DNA, 25 bp, mus musculus
actgggccaactctcctagcaaaga

SEQ ID NO: 109188 - DNA, 25 bp, mus musculus
ccaactctcctagcaaagagaagga

SEQ ID NO: 109189 - DNA, 25 bp, mus musculus
agaaggacttcctctcatgcgacct

SEQ ID NO: 109190 - DNA, 25 bp, mus musculus
acttcctctcatgcgacctcatctt

SEQ ID NO: 109191 - DNA, 25 bp, mus musculus
cacctcctggaagaacaaggagtgg

SEQ ID NO: 109192 - DNA, 25 bp, mus musculus
ctgccagccagtgccccattattga

SEQ ID NO: 109193 - DNA, 25 bp, mus musculus
accctgcctgggaatctccagaagg

SEQ ID NO: 109194 - DNA, 25 bp, mus musculus
cctgcctgggaatctccagaaggag

SEQ ID NO: 109195 - DNA, 25 bp, mus musculus
tgcctgggaatctccagaaggagta

SEQ ID NO: 109196 - DNA, 25 bp, mus musculus
gtacccattgagggtatcatctttg

SEQ ID NO: 109197 - DNA, 25 bp, mus musculus
ggtatcatctttggtggccgtagac

SEQ ID NO: 109198 - DNA, 25 bp, mus musculus
tatcatctttggtggccgtagacct

SEQ ID NO: 109199 - DNA, 25 bp, mus musculus
tcatctttggtggccgtagacctga

SEQ ID NO: 109200 - DNA, 25 bp, mus musculus
atctttggtggccgtagacctgaag

SEQ ID NO: 109201 - DNA, 25 bp, mus musculus
ttggtggccgtagacctgaaggtgt

SEQ ID NO: 109202 - DNA, 25 bp, mus musculus
aggccacagctgctgcagaacacaa

SEQ ID NO: 109203 - DNA, 25 bp, mus musculus
gccagccagtgccccattattgacc

SEQ ID NO: 109204 - DNA, 25 bp, mus musculus
cagccagtgccccattattgaccct

SEQ ID NO: 109205 - DNA, 25 bp, mus musculus
gccagtgccccattattgaccctgc

SEQ ID NO: 109206 - DNA, 25 bp, mus musculus
cagtgccccattattgaccctgcct

SEQ ID NO: 109207 - DNA, 25 bp, mus musculus
gccccattattgaccctgcctggga

SEQ ID NO: 109208 - DNA, 25 bp, mus musculus
cccattattgaccctgcctgggaat

SEQ ID NO: 109209 - DNA, 25 bp, mus musculus
attgaccctgcctgggaatctccag

SEQ ID NO: 109210 - DNA, 25 bp, mus musculus
tgaccctgcctgggaatctccagaa

SEQ ID NO: 109211 - DNA, 25 bp, mus musculus
gaatgaaagaccccttcataaggct

SEQ ID NO: 109212 - DNA, 25 bp, mus musculus
gaccccttcataaggcttagccagc

SEQ ID NO: 109213 - DNA, 25 bp, mus musculus
aactgcagtaacgccatcttgcaag

SEQ ID NO: 109214 - DNA, 25 bp, mus musculus
gcagtaacgccatcttgcaaggcat

SEQ ID NO: 109215 - DNA, 25 bp, mus musculus
acgccatcttgcaaggcatgggaaa

SEQ ID NO: 109216 - DNA, 25 bp, mus musculus
catcttgcaaggcatgggaaaatac

SEQ ID NO: 109217 - DNA, 25 bp, mus musculus
taccagagctgatgttctcagaaaa

SEQ ID NO: 109218 - DNA, 25 bp, mus musculus
tctgtggtcaagcactagggccccg

SEQ ID NO: 109219 - DNA, 25 bp, mus musculus
caagaacagatggtccccagaaata

SEQ ID NO: 109220 - DNA, 25 bp, mus musculus
agaacagatggtccccagaaatagc

SEQ ID NO: 109221 - DNA, 25 bp, mus musculus
aacagatggtccccagaaatagcta

SEQ ID NO: 109222 - DNA, 25 bp, mus musculus
cagatggtccccagaaatagctaaa

SEQ ID NO: 109223 - DNA, 25 bp, mus musculus
ccccttcataaggcttagccagcta

SEQ ID NO: 109224 - DNA, 25 bp, mus musculus
ttcataaggcttagccagctaactg

SEQ ID NO: 109225 - DNA, 25 bp, mus musculus
taaggcttagccagctaactgcagt

SEQ ID NO: 109226 - DNA, 25 bp, mus musculus
aggcttagccagctaactgcagtaa

SEQ ID NO: 109227 - DNA, 25 bp, mus musculus
gcttagccagctaactgcagtaacg

SEQ ID NO: 109228 - DNA, 25 bp, mus musculus
ttagccagctaactgcagtaacgcc

SEQ ID NO: 109229 - DNA, 25 bp, mus musculus
agctaactgcagtaacgccatcttg

SEQ ID NO: 109230 - DNA, 25 bp, mus musculus
ctaactgcagtaacgccatcttgca

SEQ ID NO: 109231 - DNA, 25 bp, mus musculus
tcttcaaggctgctgtggactctgg

SEQ ID NO: 109232 - DNA, 25 bp, mus musculus
aggctgctgtggactctggctttct

SEQ ID NO: 109233 - DNA, 25 bp, mus musculus
aggtcgtctacctggtgggcaagag

SEQ ID NO: 109234 - DNA, 25 bp, mus musculus
tctacctggtgggcaagagatgcat

SEQ ID NO: 109235 - DNA, 25 bp, mus musculus
ggaggcaccaactgccagatacgtg

SEQ ID NO: 109236 - DNA, 25 bp, mus musculus
gcccaccgtatgtgatctccaaagg

SEQ ID NO: 109237 - DNA, 25 bp, mus musculus
cgtatgtgatctccaaaggaggtca

SEQ ID NO: 109238 - DNA, 25 bp, mus musculus
tgatcctaacaaaggccgggatggc

SEQ ID NO: 109239 - DNA, 25 bp, mus musculus
tgtctgtccactgaagccacccagg

SEQ ID NO: 109240 - DNA, 25 bp, mus musculus
tccactgaagccacccaggaaaatg

SEQ ID NO: 109241 - DNA, 25 bp, mus musculus
tgtggtcttctgcagcaggtcaggt

SEQ ID NO: 109242 - DNA, 25 bp, mus musculus
ttcatccaagagctagcggaagatg

SEQ ID NO: 109243 - DNA, 25 bp, mus musculus
ctgtggactctggctttctctacat

SEQ ID NO: 109244 - DNA, 25 bp, mus musculus
gctttctctacatcttccattgcat

SEQ ID NO: 109245 - DNA, 25 bp, mus musculus
tcttccattgcatttacaaggacta

SEQ ID NO: 109246 - DNA, 25 bp, mus musculus
aggactatgacatgccccgagtggt

SEQ ID NO: 109247 - DNA, 25 bp, mus musculus
atgacatgccccgagtggtagcttg

SEQ ID NO: 109248 - DNA, 25 bp, mus musculus
tgccccgagtggtagcttgctctgt

SEQ ID NO: 109249 - DNA, 25 bp, mus musculus
tcacctacttcatggtagtcacggc

SEQ ID NO: 109250 - DNA, 25 bp, mus musculus
cagccatttgtattctactcaacct

SEQ ID NO: 109251 - DNA, 25 bp, mus musculus
aatacaggtgccctgtgccctaatc

SEQ ID NO: 109252 - DNA, 25 bp, mus musculus
tacaggtgccctgtgccctaatcct

SEQ ID NO: 109253 - DNA, 25 bp, mus musculus
ctatacccagacaagagagtattat

SEQ ID NO: 109254 - DNA, 25 bp, mus musculus
tcctctgcacactcaagagagccaa

SEQ ID NO: 109255 - DNA, 25 bp, mus musculus
ctctgcacactcaagagagccaagg

SEQ ID NO: 109256 - DNA, 25 bp, mus musculus
gcacactcaagagagccaaggcagc

SEQ ID NO: 109257 - DNA, 25 bp, mus musculus
acactcaagagagccaaggcagctg

SEQ ID NO: 109258 - DNA, 25 bp, mus musculus
gccaaggcagctgtggctttgccca

SEQ ID NO: 109259 - DNA, 25 bp, mus musculus
caaggcagctgtggctttgcccata

SEQ ID NO: 109260 - DNA, 25 bp, mus musculus
gcagctgtggctttgcccatacata

SEQ ID NO: 109261 - DNA, 25 bp, mus musculus
agctgtggctttgcccatacataga

SEQ ID NO: 109262 - DNA, 25 bp, mus musculus
ctgtggctttgcccatacatagagc

SEQ ID NO: 109263 - DNA, 25 bp, mus musculus
caggtgccctgtgccctaatcctac

SEQ ID NO: 109264 - DNA, 25 bp, mus musculus
ggctttgcccatacatagagcccca

SEQ ID NO: 109265 - DNA, 25 bp, mus musculus
tgccctgtgccctaatcctacagat

SEQ ID NO: 109266 - DNA, 25 bp, mus musculus
ccctgtgccctaatcctacagattg

SEQ ID NO: 109267 - DNA, 25 bp, mus musculus
gtgccctaatcctacagattggggg

SEQ ID NO: 109268 - DNA, 25 bp, mus musculus
tgtgaatatgccctttgtccagtgc

SEQ ID NO: 109269 - DNA, 25 bp, mus musculus
gaccattgtcccctatacccagaca

SEQ ID NO: 109270 - DNA, 25 bp, mus musculus
tcccctatacccagacaagagagta

SEQ ID NO: 109271 - DNA, 25 bp, mus musculus
ccctatacccagacaagagagtatt

SEQ ID NO: 109272 - DNA, 25 bp, mus musculus
gccactgagccatggccgagaccta

SEQ ID NO: 109273 - DNA, 25 bp, mus musculus
gagccatggccgagacctacgactt

SEQ ID NO: 109274 - DNA, 25 bp, mus musculus
aatcatgtcttctccaccagtttat

SEQ ID NO: 109275 - DNA, 25 bp, mus musculus
catgtcttctccaccagtttattga

SEQ ID NO: 109276 - DNA, 25 bp, mus musculus
gtcttctccaccagtttattgagaa

SEQ ID NO: 109277 - DNA, 25 bp, mus musculus
ttctccaccagtttattgagaataa

SEQ ID NO: 109278 - DNA, 25 bp, mus musculus
tcaaacaggactccaaccacactat

SEQ ID NO: 109279 - DNA, 25 bp, mus musculus
aacaggactccaaccacactatcgg

SEQ ID NO: 109280 - DNA, 25 bp, mus musculus
ccaaccacactatcggcgtggagtt

SEQ ID NO: 109281 - DNA, 25 bp, mus musculus
accacactatcggcgtggagtttgg

SEQ ID NO: 109282 - DNA, 25 bp, mus musculus
acactatcggcgtggagtttggatc

SEQ ID NO: 109283 - DNA, 25 bp, mus musculus
ctatcggcgtggagtttggatccag

SEQ ID NO: 109284 - DNA, 25 bp, mus musculus
ccatggccgagacctacgacttcct

SEQ ID NO: 109285 - DNA, 25 bp, mus musculus
tggccgagacctacgacttcctctt

SEQ ID NO: 109286 - DNA, 25 bp, mus musculus
acttcctcttcaaattcctggtgat

SEQ ID NO: 109287 - DNA, 25 bp, mus musculus
tcctcttcaaattcctggtgattgg

SEQ ID NO: 109288 - DNA, 25 bp, mus musculus
tcttcaaattcctggtgattggcag

SEQ ID NO: 109289 - DNA, 25 bp, mus musculus
tcaaattcctggtgattggcagtgc

SEQ ID NO: 109290 - DNA, 25 bp, mus musculus
aattcctggtgattggcagtgctgg

SEQ ID NO: 109291 - DNA, 25 bp, mus musculus
gcaaatcatgtcttctccaccagtt

SEQ ID NO: 109292 - DNA, 25 bp, mus musculus
actacacaaatgacttgggatcttt

SEQ ID NO: 109293 - DNA, 25 bp, mus musculus
tttgatttcagccttccagctgttg

SEQ ID NO: 109294 - DNA, 25 bp, mus musculus
gtacacatatgtgcctagagccaaa

SEQ ID NO: 109295 - DNA, 25 bp, mus musculus
tttatgaccttatgttgagactaat

SEQ ID NO: 109296 - DNA, 25 bp, mus musculus
tgagactaatttcacatcttatttt

SEQ ID NO: 109297 - DNA, 25 bp, mus musculus
gactaatttcacatcttattttaca

SEQ ID NO: 109298 - DNA, 25 bp, mus musculus
cacatcttattttacagtcatttac

SEQ ID NO: 109299 - DNA, 25 bp, mus musculus
atcttattttacagtcatttacagt

SEQ ID NO: 109300 - DNA, 25 bp, mus musculus
tgaaacaatgttccagctagcttta

SEQ ID NO: 109301 - DNA, 25 bp, mus musculus
aatgttccagctagctttaaaagct

SEQ ID NO: 109302 - DNA, 25 bp, mus musculus
gttccagctagctttaaaagctata

SEQ ID NO: 109303 - DNA, 25 bp, mus musculus
ttttactgctagcttgcaaaattat

SEQ ID NO: 109304 - DNA, 25 bp, mus musculus
cttccagctgttgctgtgagttgtt

SEQ ID NO: 109305 - DNA, 25 bp, mus musculus
gttgctgtgagttgttccagacctt

SEQ ID NO: 109306 - DNA, 25 bp, mus musculus
agttgttccagacctttctgtggct

SEQ ID NO: 109307 - DNA, 25 bp, mus musculus
tgttccagacctttctgtggctttt

SEQ ID NO: 109308 - DNA, 25 bp, mus musculus
tccagacctttctgtggctttttgg

SEQ ID NO: 109309 - DNA, 25 bp, mus musculus
ttctgtggctttttggtaaggctgc

SEQ ID NO: 109310 - DNA, 25 bp, mus musculus
tttttggtaaggctgcttagaagca

SEQ ID NO: 109311 - DNA, 25 bp, mus musculus
aaagtacacatatgtgcctagagcc

SEQ ID NO: 109312 - DNA, 25 bp, mus musculus
gttctataaggcatgcccaaatatg

SEQ ID NO: 109313 - DNA, 25 bp, mus musculus
atgcccaaatatggtcccaggactg

SEQ ID NO: 109314 - DNA, 25 bp, mus musculus
aatccactggcgaccagaaatcaaa

SEQ ID NO: 109315 - DNA, 25 bp, mus musculus
aatcaaacagtatcagccttgtgct

SEQ ID NO: 109316 - DNA, 25 bp, mus musculus
acagtatcagccttgtgctatggaa

SEQ ID NO: 109317 - DNA, 25 bp, mus musculus
acacctgacgtaggttacatcatca

SEQ ID NO: 109318 - DNA, 25 bp, mus musculus
tggtctcatggttttgagggctgaa

SEQ ID NO: 109319 - DNA, 25 bp, mus musculus
agcacaggtcaaagctcatgcccta

SEQ ID NO: 109320 - DNA, 25 bp, mus musculus
agctcatgccctaagctaggaagaa

SEQ ID NO: 109321 - DNA, 25 bp, mus musculus
cagtgtcctacagacccttctgaga

SEQ ID NO: 109322 - DNA, 25 bp, mus musculus
cctacagacccttctgagaacctgt

SEQ ID NO: 109323 - DNA, 25 bp, mus musculus
atcaccctgggagcaagcctttgag

SEQ ID NO: 109324 - DNA, 25 bp, mus musculus
aggactgtctgtggaccttacaatc

SEQ ID NO: 109325 - DNA, 25 bp, mus musculus
ggacactgcactcagacatggatcc

SEQ ID NO: 109326 - DNA, 25 bp, mus musculus
ggaccttacaatccaggatgctgaa

SEQ ID NO: 109327 - DNA, 25 bp, mus musculus
tgctgaagtcacactgcctggtttg

SEQ ID NO: 109328 - DNA, 25 bp, mus musculus
actgcctggtttggtgatgtcactc

SEQ ID NO: 109329 - DNA, 25 bp, mus musculus
cacaaaagacctgcctctcttgtaa

SEQ ID NO: 109330 - DNA, 25 bp, mus musculus
agacctgcctctcttgtaaacttgg

SEQ ID NO: 109331 - DNA, 25 bp, mus musculus
gcctctcttgtaaacttgggcactt

SEQ ID NO: 109332 - DNA, 25 bp, mus musculus
ttgtggaatccactggcgaccagaa

SEQ ID NO: 109333 - DNA, 25 bp, mus musculus
catttcttgctcgtggtgatgtgca

SEQ ID NO: 109334 - DNA, 25 bp, mus musculus
atttcttgctcgtggtgatgtgcat

SEQ ID NO: 109335 - DNA, 25 bp, mus musculus
cgaatgtgcgtcagtgcagagctac

SEQ ID NO: 109336 - DNA, 25 bp, mus musculus
tgtgcgtcagtgcagagctactcgg

SEQ ID NO: 109337 - DNA, 25 bp, mus musculus
tgaagttctcaatgtcgtgatggat

SEQ ID NO: 109338 - DNA, 25 bp, mus musculus
gaagttctcaatgtcgtgatggatg

SEQ ID NO: 109339 - DNA, 25 bp, mus musculus
aagttctcaatgtcgtgatggatgc

SEQ ID NO: 109340 - DNA, 25 bp, mus musculus
agttctcaatgtcgtgatggatgcc

SEQ ID NO: 109341 - DNA, 25 bp, mus musculus
gttctcaatgtcgtgatggatgcca

SEQ ID NO: 109342 - DNA, 25 bp, mus musculus
tctcaatgtcgtgatggatgccaaa

SEQ ID NO: 109343 - DNA, 25 bp, mus musculus
ttacacggaccagcgggagcccctg

SEQ ID NO: 109344 - DNA, 25 bp, mus musculus
tacacggaccagcgggagcccctgg

SEQ ID NO: 109345 - DNA, 25 bp, mus musculus
tttcttgctcgtggtgatgtgcatg

SEQ ID NO: 109346 - DNA, 25 bp, mus musculus
tgatgtgcatggccgaatgtgcgtc

SEQ ID NO: 109347 - DNA, 25 bp, mus musculus
gatgtgcatggccgaatgtgcgtca

SEQ ID NO: 109348 - DNA, 25 bp, mus musculus
atgtgcatggccgaatgtgcgtcag

SEQ ID NO: 109349 - DNA, 25 bp, mus musculus
catggccgaatgtgcgtcagtgcag

SEQ ID NO: 109350 - DNA, 25 bp, mus musculus
atggccgaatgtgcgtcagtgcaga

SEQ ID NO: 109351 - DNA, 25 bp, mus musculus
tggccgaatgtgcgtcagtgcagag

SEQ ID NO: 109352 - DNA, 25 bp, mus musculus
ccgaatgtgcgtcagtgcagagcta

SEQ ID NO: 109353 - DNA, 25 bp, mus musculus
ttatctggcttagtttgtggagact

SEQ ID NO: 109354 - DNA, 25 bp, mus musculus
tagtttgtggagactccggaatgcg

SEQ ID NO: 109355 - DNA, 25 bp, mus musculus
taagtcttggggtctggaatgtgac

SEQ ID NO: 109356 - DNA, 25 bp, mus musculus
aagtcttggggtctggaatgtgaca

SEQ ID NO: 109357 - DNA, 25 bp, mus musculus
gacagactccagttgggactggatt

SEQ ID NO: 109358 - DNA, 25 bp, mus musculus
acagactccagttgggactggattc

SEQ ID NO: 109359 - DNA, 25 bp, mus musculus
agactccagttgggactggattcag

SEQ ID NO: 109360 - DNA, 25 bp, mus musculus
gactccagttgggactggattcagg

SEQ ID NO: 109361 - DNA, 25 bp, mus musculus
ctggattcaggggccgacttctcac

SEQ ID NO: 109362 - DNA, 25 bp, mus musculus
tggattcaggggccgacttctcact

SEQ ID NO: 109363 - DNA, 25 bp, mus musculus
attcaggggccgacttctcacttgc

SEQ ID NO: 109364 - DNA, 25 bp, mus musculus
aaccccaactactgagagatgaatc

SEQ ID NO: 109365 - DNA, 25 bp, mus musculus
tttgtggagactccggaatgcggag

SEQ ID NO: 109366 - DNA, 25 bp, mus musculus
accccaactactgagagatgaatca

SEQ ID NO: 109367 - DNA, 25 bp, mus musculus
atcaaagcagtggccaacgcgacgt

SEQ ID NO: 109368 - DNA, 25 bp, mus musculus
caaagcagtggccaacgcgacgtta

SEQ ID NO: 109369 - DNA, 25 bp, mus musculus
ggccaacgcgacgttaagtttgcag

SEQ ID NO: 109370 - DNA, 25 bp, mus musculus
agtttgcaggactgcgttgttaagt

SEQ ID NO: 109371 - DNA, 25 bp, mus musculus
tttgcaggactgcgttgttaagtct

SEQ ID NO: 109372 - DNA, 25 bp, mus musculus
ttgcaggactgcgttgttaagtctt

SEQ ID NO: 109373 - DNA, 25 bp, mus musculus
gttaagtcttggggtctggaatgtg

SEQ ID NO: 109374 - DNA, 25 bp, mus musculus
atcctaaccagggatcagctgaaga

SEQ ID NO: 109375 - DNA, 25 bp, mus musculus
gtatttcagcaaacccagccagtgt

SEQ ID NO: 109376 - DNA, 25 bp, mus musculus
tcactcagatgacctttttccgtct

SEQ ID NO: 109377 - DNA, 25 bp, mus musculus
aagcctcgcagaaccttacttacat

SEQ ID NO: 109378 - DNA, 25 bp, mus musculus
cgcagaaccttacttacatctgtag

SEQ ID NO: 109379 - DNA, 25 bp, mus musculus
gattcagatacacagttcttcaaga

SEQ ID NO: 109380 - DNA, 25 bp, mus musculus
cagttcttcaagacacctgctctaa

SEQ ID NO: 109381 - DNA, 25 bp, mus musculus
ttcaagacacctgctctaagcgaaa

SEQ ID NO: 109382 - DNA, 25 bp, mus musculus
acacctgctctaagcgaaatggaaa

SEQ ID NO: 109383 - DNA, 25 bp, mus musculus
tcatagatgttggtcctgtggatat

SEQ ID NO: 109384 - DNA, 25 bp, mus musculus
atgttggtcctgtggatattggcaa

SEQ ID NO: 109385 - DNA, 25 bp, mus musculus
aatttggccttgatattgggccagt

SEQ ID NO: 109386 - DNA, 25 bp, mus musculus
cagcaaacccagccagtgttccacg

SEQ ID NO: 109387 - DNA, 25 bp, mus musculus
tattgggccagtttgtttcatgtaa

SEQ ID NO: 109388 - DNA, 25 bp, mus musculus
gggccagcaaatcccctgacaataa

SEQ ID NO: 109389 - DNA, 25 bp, mus musculus
cccctgacaataagcctgtgtggta

SEQ ID NO: 109390 - DNA, 25 bp, mus musculus
acaataagcctgtgtggtacggtct

SEQ ID NO: 109391 - DNA, 25 bp, mus musculus
agcctgtgtggtacggtcttgacat

SEQ ID NO: 109392 - DNA, 25 bp, mus musculus
attaccagtctcctaacacagctat

SEQ ID NO: 109393 - DNA, 25 bp, mus musculus
agtctcctaacacagctatcactca

SEQ ID NO: 109394 - DNA, 25 bp, mus musculus
ctaacacagctatcactcagatgac

SEQ ID NO: 109395 - DNA, 25 bp, mus musculus
tatatcacctttcttgaggacctca

SEQ ID NO: 109396 - DNA, 25 bp, mus musculus
tatcacctttcttgaggacctcaaa

SEQ ID NO: 109397 - DNA, 25 bp, mus musculus
aagctttggccagtgaacaaaagct

SEQ ID NO: 109398 - DNA, 25 bp, mus musculus
agtgaacaaaagctcccttggcatc

SEQ ID NO: 109399 - DNA, 25 bp, mus musculus
gtgaacaaaagctcccttggcatca

SEQ ID NO: 109400 - DNA, 25 bp, mus musculus
gaacaaaagctcccttggcatcaga

SEQ ID NO: 109401 - DNA, 25 bp, mus musculus
aagctcccttggcatcagatttatg

SEQ ID NO: 109402 - DNA, 25 bp, mus musculus
agctcccttggcatcagatttatgc

SEQ ID NO: 109403 - DNA, 25 bp, mus musculus
tcccttggcatcagatttatgcttc

SEQ ID NO: 109404 - DNA, 25 bp, mus musculus
aaatggctgtcatcctaatatatgg

SEQ ID NO: 109405 - DNA, 25 bp, mus musculus
atggctgtcatcctaatatatgggg

SEQ ID NO: 109406 - DNA, 25 bp, mus musculus
tggctgtcatcctaatatatggggg

SEQ ID NO: 109407 - DNA, 25 bp, mus musculus
agctttgtcaagaaccagtagaact

SEQ ID NO: 109408 - DNA, 25 bp, mus musculus
tagaactcagagactgcgggcctta

SEQ ID NO: 109409 - DNA, 25 bp, mus musculus
gaactcagagactgcgggccttaat

SEQ ID NO: 109410 - DNA, 25 bp, mus musculus
aactcagagactgcgggccttaatt

SEQ ID NO: 109411 - DNA, 25 bp, mus musculus
aatggcaagctttggccagtgaaca

SEQ ID NO: 109412 - DNA, 25 bp, mus musculus
tggcaagctttggccagtgaacaaa

SEQ ID NO: 109413 - DNA, 25 bp, mus musculus
ggcaagctttggccagtgaacaaaa

SEQ ID NO: 109414 - DNA, 25 bp, mus musculus
caagctttggccagtgaacaaaagc

SEQ ID NO: 109415 - DNA, 25 bp, mus musculus
ggatcttggagctttgcctaaaaag

SEQ ID NO: 109416 - DNA, 25 bp, mus musculus
tcactctgcattctccagtcacaga

SEQ ID NO: 109417 - DNA, 25 bp, mus musculus
ggcttacaaagcttgactggtcgta

SEQ ID NO: 109418 - DNA, 25 bp, mus musculus
ggtcgtagctatggcctgtgtccac

SEQ ID NO: 109419 - DNA, 25 bp, mus musculus
tgtccacaggtacaggccagaagta

SEQ ID NO: 109420 - DNA, 25 bp, mus musculus
acaactatgacaccacactagaccc

SEQ ID NO: 109421 - DNA, 25 bp, mus musculus
atgacaccacactagacccagacag

SEQ ID NO: 109422 - DNA, 25 bp, mus musculus
tagacccagacaggacaagaggggc

SEQ ID NO: 109423 - DNA, 25 bp, mus musculus
agaggacacagaactcctgatgctg

SEQ ID NO: 109424 - DNA, 25 bp, mus musculus
cacaccatcctgcacttaggaaatg

SEQ ID NO: 109425 - DNA, 25 bp, mus musculus
atcctgcacttaggaaatggcataa

SEQ ID NO: 109426 - DNA, 25 bp, mus musculus
gcactttccactgtctaaaaacatt

SEQ ID NO: 109427 - DNA, 25 bp, mus musculus
tgcattctccagtcacagaggtgac

SEQ ID NO: 109428 - DNA, 25 bp, mus musculus
ctccagtcacagaggtgactgttgc

SEQ ID NO: 109429 - DNA, 25 bp, mus musculus
caactgaaaacactcaaagttcact

SEQ ID NO: 109430 - DNA, 25 bp, mus musculus
ttcctcagaggaggtgacatggtta

SEQ ID NO: 109431 - DNA, 25 bp, mus musculus
accttcagttaccatggtgcagatg

SEQ ID NO: 109432 - DNA, 25 bp, mus musculus
agttaccatggtgcagatgccaatc

SEQ ID NO: 109433 - DNA, 25 bp, mus musculus
gcagatgccaatcaccttcccactg

SEQ ID NO: 109434 - DNA, 25 bp, mus musculus
cccactggcttacaaagcttgactg

SEQ ID NO: 109435 - DNA, 25 bp, mus musculus
cgtgctgacgaacggcgagccgagc

SEQ ID NO: 109436 - DNA, 25 bp, mus musculus
tgctgacgaacggcgagccgagcag

SEQ ID NO: 109437 - DNA, 25 bp, mus musculus
cctgctgctgggctcaggcgagact

SEQ ID NO: 109438 - DNA, 25 bp, mus musculus
ctgctgctgggctcaggcgagactg

SEQ ID NO: 109439 - DNA, 25 bp, mus musculus
ctgctgggctcaggcgagactgcaa

SEQ ID NO: 109440 - DNA, 25 bp, mus musculus
ggctcaggcgagactgcaagtccag

SEQ ID NO: 109441 - DNA, 25 bp, mus musculus
gagactgcaagtccagcttcctgaa

SEQ ID NO: 109442 - DNA, 25 bp, mus musculus
gactgcaagtccagcttcctgaagc

SEQ ID NO: 109443 - DNA, 25 bp, mus musculus
acttcgaccagcgcgcgcgatggta

SEQ ID NO: 109444 - DNA, 25 bp, mus musculus
ttcgaccagcgcgcgcgatggtagt

SEQ ID NO: 109445 - DNA, 25 bp, mus musculus
gaccagcgcgcgcgatggtagttcc

SEQ ID NO: 109446 - DNA, 25 bp, mus musculus
accagcgcgcgcgatggtagttccg

SEQ ID NO: 109447 - DNA, 25 bp, mus musculus
tgacgaacggcgagccgagcagcag

SEQ ID NO: 109448 - DNA, 25 bp, mus musculus
agccgagcagcagccaacgtccacg

SEQ ID NO: 109449 - DNA, 25 bp, mus musculus
gccgagcagcagccaacgtccacgg

SEQ ID NO: 109450 - DNA, 25 bp, mus musculus
cgagcagcagccaacgtccacggag

SEQ ID NO: 109451 - DNA, 25 bp, mus musculus
cagcagccaacgtccacggagatcg

SEQ ID NO: 109452 - DNA, 25 bp, mus musculus
gccaacgtccacggagatcgacata

SEQ ID NO: 109453 - DNA, 25 bp, mus musculus
ccaacgtccacggagatcgacatat

SEQ ID NO: 109454 - DNA, 25 bp, mus musculus
aacgtccacggagatcgacatatgc

SEQ ID NO: 109455 - DNA, 25 bp, mus musculus
gagattctgccatagagctttgagc

SEQ ID NO: 109456 - DNA, 25 bp, mus musculus
attctgccatagagctttgagcagg

SEQ ID NO: 109457 - DNA, 25 bp, mus musculus
ttatgctactatacacgattttcat

SEQ ID NO: 109458 - DNA, 25 bp, mus musculus
tatacacgattttcattcttggtag

SEQ ID NO: 109459 - DNA, 25 bp, mus musculus
cgattttcattcttggtaggtatca

SEQ ID NO: 109460 - DNA, 25 bp, mus musculus
aagattgcccatgtatttgcatctc

SEQ ID NO: 109461 - DNA, 25 bp, mus musculus
attgcccatgtatttgcatctcagt

SEQ ID NO: 109462 - DNA, 25 bp, mus musculus
gcccatgtatttgcatctcagtggg

SEQ ID NO: 109463 - DNA, 25 bp, mus musculus
gtatttgcatctcagtgggttcttt

SEQ ID NO: 109464 - DNA, 25 bp, mus musculus
tttcaaatctgtcccacctttgtgt

SEQ ID NO: 109465 - DNA, 25 bp, mus musculus
cccacctttgtgtcttccatatatt

SEQ ID NO: 109466 - DNA, 25 bp, mus musculus
gttagcatcagggaggcaagccatg

SEQ ID NO: 109467 - DNA, 25 bp, mus musculus
caggaatccaagtcctcaacatggc

SEQ ID NO: 109468 - DNA, 25 bp, mus musculus
gaatccaagtcctcaacatggcatt

SEQ ID NO: 109469 - DNA, 25 bp, mus musculus
tcaacatggcatttcctttatgaaa

SEQ ID NO: 109470 - DNA, 25 bp, mus musculus
tggcatttcctttatgaaaagacag

SEQ ID NO: 109471 - DNA, 25 bp, mus musculus
gtttgcaggcgagcttccctggcct

SEQ ID NO: 109472 - DNA, 25 bp, mus musculus
tccctggcctgaccctctaggtgtg

SEQ ID NO: 109473 - DNA, 25 bp, mus musculus
ccctctaggtgtggatggaccttat

SEQ ID NO: 109474 - DNA, 25 bp, mus musculus
accttatgctactatacacgatttt

SEQ ID NO: 109475 - DNA, 25 bp, mus musculus
ttaccaatctgaagtgggagccaag

SEQ ID NO: 109476 - DNA, 25 bp, mus musculus
ggtagacaccattatacacaagaaa

SEQ ID NO: 109477 - DNA, 25 bp, mus musculus
tttggcactggcgtggttgatgcca

SEQ ID NO: 109478 - DNA, 25 bp, mus musculus
tggcactggcgtggttgatgccaac

SEQ ID NO: 109479 - DNA, 25 bp, mus musculus
aacgaacacggcaatacagcgcata

SEQ ID NO: 109480 - DNA, 25 bp, mus musculus
cgaacacggcaatacagcgcataac

SEQ ID NO: 109481 - DNA, 25 bp, mus musculus
cggcaatacagcgcataacgctggc

SEQ ID NO: 109482 - DNA, 25 bp, mus musculus
aatacagcgcataacgctggcccat

SEQ ID NO: 109483 - DNA, 25 bp, mus musculus
tacagcgcataacgctggcccattc

SEQ ID NO: 109484 - DNA, 25 bp, mus musculus
gcgcataacgctggcccattctctc

SEQ ID NO: 109485 - DNA, 25 bp, mus musculus
aacgctggcccattctctcttgaac

SEQ ID NO: 109486 - DNA, 25 bp, mus musculus
cgctggcccattctctcttgaactt

SEQ ID NO: 109487 - DNA, 25 bp, mus musculus
tagacaccattatacacaagaaact

SEQ ID NO: 109488 - DNA, 25 bp, mus musculus
ggcccattctctcttgaacttgtgt

SEQ ID NO: 109489 - DNA, 25 bp, mus musculus
caccattatacacaagaaactgagt

SEQ ID NO: 109490 - DNA, 25 bp, mus musculus
ccattatacacaagaaactgagtga

SEQ ID NO: 109491 - DNA, 25 bp, mus musculus
tgagtgatcagcgtactaggaaggc

SEQ ID NO: 109492 - DNA, 25 bp, mus musculus
tgatcagcgtactaggaaggcgatg

SEQ ID NO: 109493 - DNA, 25 bp, mus musculus
taatcccaagcccaaggccgcttcg

SEQ ID NO: 109494 - DNA, 25 bp, mus musculus
gatcaaatgtccaccacaaacccaa

SEQ ID NO: 109495 - DNA, 25 bp, mus musculus
ctaatttggcactggcgtggttgat

SEQ ID NO: 109496 - DNA, 25 bp, mus musculus
tccgtctctccagttctatagttca

SEQ ID NO: 109497 - DNA, 25 bp, mus musculus
tctccagttctatagttcaggcatc

SEQ ID NO: 109498 - DNA, 25 bp, mus musculus
ggttctgttggtgggctatggctat

SEQ ID NO: 109499 - DNA, 25 bp, mus musculus
caaccactgtggacttgccaccgcg

SEQ ID NO: 109500 - DNA, 25 bp, mus musculus
caccgcggccagctatcctgtcgtg

SEQ ID NO: 109501 - DNA, 25 bp, mus musculus
ggccagctatcctgtcgtgaattga

SEQ ID NO: 109502 - DNA, 25 bp, mus musculus
cagctatcctgtcgtgaattgatgg

SEQ ID NO: 109503 - DNA, 25 bp, mus musculus
ctatcctgtcgtgaattgatgggta

SEQ ID NO: 109504 - DNA, 25 bp, mus musculus
tggacactatgtccaaaggaattca

SEQ ID NO: 109505 - DNA, 25 bp, mus musculus
tgaattctgttcccatttttacatg

SEQ ID NO: 109506 - DNA, 25 bp, mus musculus
gtgcttaattctgagtctggaatat

SEQ ID NO: 109507 - DNA, 25 bp, mus musculus
cttaattctgagtctggaatatttg

SEQ ID NO: 109508 - DNA, 25 bp, mus musculus
tagttcaggcatctactatgaaccc

SEQ ID NO: 109509 - DNA, 25 bp, mus musculus
ttcaggcatctactatgaacccaac

SEQ ID NO: 109510 - DNA, 25 bp, mus musculus
aggcatctactatgaacccaactgt

SEQ ID NO: 109511 - DNA, 25 bp, mus musculus
ctactatgaacccaactgtagcagc

SEQ ID NO: 109512 - DNA, 25 bp, mus musculus
ctatgaacccaactgtagcagcaag

SEQ ID NO: 109513 - DNA, 25 bp, mus musculus
tgaacccaactgtagcagcaagaac

SEQ ID NO: 109514 - DNA, 25 bp, mus musculus
gaacctcgaccatggggttctgttg

SEQ ID NO: 109515 - DNA, 25 bp, mus musculus
ccatggggttctgttggtgggctat

SEQ ID NO: 109516 - DNA, 25 bp, mus musculus
gcactgctgttcgtactggtgctag

SEQ ID NO: 109517 - DNA, 25 bp, mus musculus
ctgctgttcgtactggtgctaggga

SEQ ID NO: 109518 - DNA, 25 bp, mus musculus
gatcaatgtcaacacagaggatgac

SEQ ID NO: 109519 - DNA, 25 bp, mus musculus
atcaatgtcaacacagaggatgacg

SEQ ID NO: 109520 - DNA, 25 bp, mus musculus
aatgtcaacacagaggatgacgacg

SEQ ID NO: 109521 - DNA, 25 bp, mus musculus
tgacgacgacgatgacgacgatgac

SEQ ID NO: 109522 - DNA, 25 bp, mus musculus
tacttgttgtacctttctgccatct

SEQ ID NO: 109523 - DNA, 25 bp, mus musculus
acttgttgtacctttctgccatctg

SEQ ID NO: 109524 - DNA, 25 bp, mus musculus
ttgttgtacctttctgccatctgtg

SEQ ID NO: 109525 - DNA, 25 bp, mus musculus
tgttgtacctttctgccatctgtgc

SEQ ID NO: 109526 - DNA, 25 bp, mus musculus
tgtacctttctgccatctgtgccct

SEQ ID NO: 109527 - DNA, 25 bp, mus musculus
tacctttctgccatctgtgcccttc

SEQ ID NO: 109528 - DNA, 25 bp, mus musculus
gctgttcgtactggtgctagggacg

SEQ ID NO: 109529 - DNA, 25 bp, mus musculus
ttcgtactggtgctagggacgccca

SEQ ID NO: 109530 - DNA, 25 bp, mus musculus
cgtactggtgctagggacgcccagg

SEQ ID NO: 109531 - DNA, 25 bp, mus musculus
gtactggtgctagggacgcccaggt

SEQ ID NO: 109532 - DNA, 25 bp, mus musculus
ctggtgctagggacgcccaggttag

SEQ ID NO: 109533 - DNA, 25 bp, mus musculus
ttggacttccctgagtacgacggtg

SEQ ID NO: 109534 - DNA, 25 bp, mus musculus
tacgacggtgtggaccgtgtgatca

SEQ ID NO: 109535 - DNA, 25 bp, mus musculus
cgacggtgtggaccgtgtgatcaat

SEQ ID NO: 109536 - DNA, 25 bp, mus musculus
tgcctatcaatgtgtttgcgaccat

SEQ ID NO: 109537 - DNA, 25 bp, mus musculus
atgtgtttgcgaccatgagacagat

SEQ ID NO: 109538 - DNA, 25 bp, mus musculus
caaggtgcgccaatggcatcttgtc

SEQ ID NO: 109539 - DNA, 25 bp, mus musculus
gcgccaatggcatcttgtcatccct

SEQ ID NO: 109540 - DNA, 25 bp, mus musculus
ccaatggcatcttgtcatccctcac

SEQ ID NO: 109541 - DNA, 25 bp, mus musculus
tcacccgaatctcacttccagtgaa

SEQ ID NO: 109542 - DNA, 25 bp, mus musculus
gaatctcacttccagtgaacttgca

SEQ ID NO: 109543 - DNA, 25 bp, mus musculus
ttccagtgaacttgcagggaggcag

SEQ ID NO: 109544 - DNA, 25 bp, mus musculus
ctggtatagctcctttgtgtgagca

SEQ ID NO: 109545 - DNA, 25 bp, mus musculus
ggaactttgctaactccagcagttc

SEQ ID NO: 109546 - DNA, 25 bp, mus musculus
actttgctaactccagcagttcgtt

SEQ ID NO: 109547 - DNA, 25 bp, mus musculus
ttgctaactccagcagttcgttatg

SEQ ID NO: 109548 - DNA, 25 bp, mus musculus
tgtttgcgaccatgagacagatcgt

SEQ ID NO: 109549 - DNA, 25 bp, mus musculus
gacagatcgtgtctggatgggccca

SEQ ID NO: 109550 - DNA, 25 bp, mus musculus
gggcccaaccaactgcttcaacagc

SEQ ID NO: 109551 - DNA, 25 bp, mus musculus
aaccaactgcttcaacagctattgc

SEQ ID NO: 109552 - DNA, 25 bp, mus musculus
ctgcttcaacagctattgcaaggtg

SEQ ID NO: 109553 - DNA, 25 bp, mus musculus
cttcaacagctattgcaaggtgcgc

SEQ ID NO: 109554 - DNA, 25 bp, mus musculus
ctattgcaaggtgcgccaatggcat

SEQ ID NO: 109555 - DNA, 25 bp, mus musculus
ttgcaaggtgcgccaatggcatctt

SEQ ID NO: 109556 - DNA, 25 bp, mus musculus
atctcctatttgtgatcattcacag

SEQ ID NO: 109557 - DNA, 25 bp, mus musculus
tgatcattcacagaacagagtgatg

SEQ ID NO: 109558 - DNA, 25 bp, mus musculus
ggcttgctaaccctgtagattgcct

SEQ ID NO: 109559 - DNA, 25 bp, mus musculus
ctaaccctgtagattgcctcacaag

SEQ ID NO: 109560 - DNA, 25 bp, mus musculus
accctgtagattgcctcacaagttg

SEQ ID NO: 109561 - DNA, 25 bp, mus musculus
gcctcacaagttgtctgtttacaaa

SEQ ID NO: 109562 - DNA, 25 bp, mus musculus
agtaagctttccatccaggggatga

SEQ ID NO: 109563 - DNA, 25 bp, mus musculus
aagctttccatccaggggatgaaga

SEQ ID NO: 109564 - DNA, 25 bp, mus musculus
gcaaaccctttaatttgatgtattg

SEQ ID NO: 109565 - DNA, 25 bp, mus musculus
ctttgtattgtactgccattcctaa

SEQ ID NO: 109566 - DNA, 25 bp, mus musculus
tgtattgtactgccattcctaatgt

SEQ ID NO: 109567 - DNA, 25 bp, mus musculus
gtactgccattcctaatgtattttt

SEQ ID NO: 109568 - DNA, 25 bp, mus musculus
tcattcacagaacagagtgatggtt

SEQ ID NO: 109569 - DNA, 25 bp, mus musculus
aacagggcttccttctaaggtgcag

SEQ ID NO: 109570 - DNA, 25 bp, mus musculus
agggcttccttctaaggtgcaggat

SEQ ID NO: 109571 - DNA, 25 bp, mus musculus
gagcattctacggaaacgtattcga

SEQ ID NO: 109572 - DNA, 25 bp, mus musculus
aaaggctacgacggctcagaaggtg

SEQ ID NO: 109573 - DNA, 25 bp, mus musculus
tacgacggctcagaaggtgcagcag

SEQ ID NO: 109574 - DNA, 25 bp, mus musculus
agacacctaaatgttcatgacttga

SEQ ID NO: 109575 - DNA, 25 bp, mus musculus
tgaacctttgatgtgcaaagcaaga

SEQ ID NO: 109576 - DNA, 25 bp, mus musculus
ctcccgtcagtcatttctaggtatg

SEQ ID NO: 109577 - DNA, 25 bp, mus musculus
ccgtcagtcatttctaggtatgtgt

SEQ ID NO: 109578 - DNA, 25 bp, mus musculus
agatgccttggctctgacccatcta

SEQ ID NO: 109579 - DNA, 25 bp, mus musculus
cttggctctgacccatctactgagt

SEQ ID NO: 109580 - DNA, 25 bp, mus musculus
ccatctactgagtcagggtcttcag

SEQ ID NO: 109581 - DNA, 25 bp, mus musculus
tctactgagtcagggtcttcagagg

SEQ ID NO: 109582 - DNA, 25 bp, mus musculus
actgagtcagggtcttcagaggaag

SEQ ID NO: 109583 - DNA, 25 bp, mus musculus
ttctagcagttgtcttagctgctaa

SEQ ID NO: 109584 - DNA, 25 bp, mus musculus
tcttagctgctaagcatcattatca

SEQ ID NO: 109585 - DNA, 25 bp, mus musculus
ctgctaagcatcattatcaggcagc

SEQ ID NO: 109586 - DNA, 25 bp, mus musculus
atcattatcaggcagccagtgagca

SEQ ID NO: 109587 - DNA, 25 bp, mus musculus
attatcaggcagccagtgagcatgt

SEQ ID NO: 109588 - DNA, 25 bp, mus musculus
tcagtcatttctaggtatgtgtata

SEQ ID NO: 109589 - DNA, 25 bp, mus musculus
caccctagcattacctctgagcaaa

SEQ ID NO: 109590 - DNA, 25 bp, mus musculus
cctagcattacctctgagcaaacgg

SEQ ID NO: 109591 - DNA, 25 bp, mus musculus
aagcttgcagtgtcctgtgggtcat

SEQ ID NO: 109592 - DNA, 25 bp, mus musculus
cacacaaaatctcctgggcacaggg

SEQ ID NO: 109593 - DNA, 25 bp, mus musculus
aaatctcctgggcacagggcacaca

SEQ ID NO: 109594 - DNA, 25 bp, mus musculus
cacagggcacacagatgccttggct

SEQ ID NO: 109595 - DNA, 25 bp, mus musculus
gcacacagatgccttggctctgacc

SEQ ID NO: 109596 - DNA, 25 bp, mus musculus
tcttatctgtactcatgagggtacc

SEQ ID NO: 109597 - DNA, 25 bp, mus musculus
tatctgtactcatgagggtacctgg

SEQ ID NO: 109598 - DNA, 25 bp, mus musculus
ttgcaaataccgtaggtggtcaact

SEQ ID NO: 109599 - DNA, 25 bp, mus musculus
gtggtcaactattcctcttatttgt

SEQ ID NO: 109600 - DNA, 25 bp, mus musculus
gtcaactattcctcttatttgtggt

SEQ ID NO: 109601 - DNA, 25 bp, mus musculus
tatttctgtgggctcagcacttatc

SEQ ID NO: 109602 - DNA, 25 bp, mus musculus
tgtgggctcagcacttatcattttg

SEQ ID NO: 109603 - DNA, 25 bp, mus musculus
gggctcagcacttatcattttgatg

SEQ ID NO: 109604 - DNA, 25 bp, mus musculus
acttatcattttgatgagtgtcggc

SEQ ID NO: 109605 - DNA, 25 bp, mus musculus
gagtgtcggcttctgtatgatatta

SEQ ID NO: 109606 - DNA, 25 bp, mus musculus
agctcttcatttagaaacacgagaa

SEQ ID NO: 109607 - DNA, 25 bp, mus musculus
tcttcatttagaaacacgagaagta

SEQ ID NO: 109608 - DNA, 25 bp, mus musculus
ggtaaactgtagcttccctgaagat

SEQ ID NO: 109609 - DNA, 25 bp, mus musculus
ctgtagcttccctgaagatacaaat

SEQ ID NO: 109610 - DNA, 25 bp, mus musculus
tagcttccctgaagatacaaatgga

SEQ ID NO: 109611 - DNA, 25 bp, mus musculus
cttccctgaagatacaaatggaatc

SEQ ID NO: 109612 - DNA, 25 bp, mus musculus
tggggctactgtgactctggaatgt

SEQ ID NO: 109613 - DNA, 25 bp, mus musculus
aagtccccagagccagtgccaggat

SEQ ID NO: 109614 - DNA, 25 bp, mus musculus
gagccagtgccaggatgacagccaa

SEQ ID NO: 109615 - DNA, 25 bp, mus musculus
tcccttggctctttgcaaataccgt

SEQ ID NO: 109616 - DNA, 25 bp, mus musculus
tccccagaatccttcagaaggccag

SEQ ID NO: 109617 - DNA, 25 bp, mus musculus
ccagaatccttcagaaggccagccg

SEQ ID NO: 109618 - DNA, 25 bp, mus musculus
ggccaatttgccatcgtgcgcaagt

SEQ ID NO: 109619 - DNA, 25 bp, mus musculus
caatttgccatcgtgcgcaagtgcc

SEQ ID NO: 109620 - DNA, 25 bp, mus musculus
gccatcgtgcgcaagtgccagcaga

SEQ ID NO: 109621 - DNA, 25 bp, mus musculus
atcgtgcgcaagtgccagcagaagg

SEQ ID NO: 109622 - DNA, 25 bp, mus musculus
cgcaagtgccagcagaagggcacgg

SEQ ID NO: 109623 - DNA, 25 bp, mus musculus
gcagccaagttcatcaagaagcggc

SEQ ID NO: 109624 - DNA, 25 bp, mus musculus
aagttcatcaagaagcggcgcctgc

SEQ ID NO: 109625 - DNA, 25 bp, mus musculus
ttcatcaagaagcggcgcctgccat

SEQ ID NO: 109626 - DNA, 25 bp, mus musculus
ccatccagccggcgcggtgtgagcc

SEQ ID NO: 109627 - DNA, 25 bp, mus musculus
caccccaacatcataacactgcatg

SEQ ID NO: 109628 - DNA, 25 bp, mus musculus
gaatccttcagaaggccagccgcca

SEQ ID NO: 109629 - DNA, 25 bp, mus musculus
cccaacatcataacactgcatgacg

SEQ ID NO: 109630 - DNA, 25 bp, mus musculus
ttcagaaggccagccgccatgtcca

SEQ ID NO: 109631 - DNA, 25 bp, mus musculus
agaaggccagccgccatgtccacat

SEQ ID NO: 109632 - DNA, 25 bp, mus musculus
aggccagccgccatgtccacattca

SEQ ID NO: 109633 - DNA, 25 bp, mus musculus
gccatgtccacattcaggcaagagg

SEQ ID NO: 109634 - DNA, 25 bp, mus musculus
atgtccacattcaggcaagaggatg

SEQ ID NO: 109635 - DNA, 25 bp, mus musculus
tccacattcaggcaagaggatgttg

SEQ ID NO: 109636 - DNA, 25 bp, mus musculus
agtggccaatttgccatcgtgcgca

SEQ ID NO: 109637 - DNA, 25 bp, mus musculus
ttcagctcaagtgctatagaaagcc

SEQ ID NO: 109638 - DNA, 25 bp, mus musculus
gctatagaaagcccgacctagagag

SEQ ID NO: 109639 - DNA, 25 bp, mus musculus
ccctgctcctgagtgacagggatga

SEQ ID NO: 109640 - DNA, 25 bp, mus musculus
tctgagtgttctcctgggcaggcca

SEQ ID NO: 109641 - DNA, 25 bp, mus musculus
tgttctcctgggcaggccatggcgc

SEQ ID NO: 109642 - DNA, 25 bp, mus musculus
atggcgctccttctgggtgagcctg

SEQ ID NO: 109643 - DNA, 25 bp, mus musculus
ctccttctgggtgagcctgctcctg

SEQ ID NO: 109644 - DNA, 25 bp, mus musculus
cttaacaagccactgtgggatggac

SEQ ID NO: 109645 - DNA, 25 bp, mus musculus
aagccactgtgggatggacgaagct

SEQ ID NO: 109646 - DNA, 25 bp, mus musculus
aagtataccattcctgcttttcatg

SEQ ID NO: 109647 - DNA, 25 bp, mus musculus
gagatcacaccctgcttgggaggaa

SEQ ID NO: 109648 - DNA, 25 bp, mus musculus
ggaggaaaccatcactcttcactga

SEQ ID NO: 109649 - DNA, 25 bp, mus musculus
gaaagcccgacctagagagatatga

SEQ ID NO: 109650 - DNA, 25 bp, mus musculus
cactgaaccctgccaactatatttg

SEQ ID NO: 109651 - DNA, 25 bp, mus musculus
gatatgaggcccaggcccacggccg

SEQ ID NO: 109652 - DNA, 25 bp, mus musculus
tgagtgcctcccaagtcagcgtgca

SEQ ID NO: 109653 - DNA, 25 bp, mus musculus
gcatggatgaccggcgtcgggattc

SEQ ID NO: 109654 - DNA, 25 bp, mus musculus
tgagccaagtgtctctgtcctccct

SEQ ID NO: 109655 - DNA, 25 bp, mus musculus
aagtgtctctgtcctccctgacgtc

SEQ ID NO: 109656 - DNA, 25 bp, mus musculus
cctccctgacgtcagacagattgtc

SEQ ID NO: 109657 - DNA, 25 bp, mus musculus
aatggtccctgctcctgagtgacag

SEQ ID NO: 109658 - DNA, 25 bp, mus musculus
aagacctcctggagccgagaactga

SEQ ID NO: 109659 - DNA, 25 bp, mus musculus
ctgatcctgacaatgacagcagatg

SEQ ID NO: 109660 - DNA, 25 bp, mus musculus
gacgacttccgtgcccgctacagga

SEQ ID NO: 109661 - DNA, 25 bp, mus musculus
cgtgcccgctacaggacacaaacct

SEQ ID NO: 109662 - DNA, 25 bp, mus musculus
ctcccacgtccatcttacaaactag

SEQ ID NO: 109663 - DNA, 25 bp, mus musculus
ttactcctgagggttactgcttcct

SEQ ID NO: 109664 - DNA, 25 bp, mus musculus
tctttgccttctctaagccagagag

SEQ ID NO: 109665 - DNA, 25 bp, mus musculus
gggtccttcctggaagagactgtct

SEQ ID NO: 109666 - DNA, 25 bp, mus musculus
gagactgtctctctggcctctactc

SEQ ID NO: 109667 - DNA, 25 bp, mus musculus
tctctggcctctactccttatcctt

SEQ ID NO: 109668 - DNA, 25 bp, mus musculus
tctactccttatccttgtagtctgt

SEQ ID NO: 109669 - DNA, 25 bp, mus musculus
ccttatccttgtagtctgtgtgatt

SEQ ID NO: 109670 - DNA, 25 bp, mus musculus
atcctgacaatgacagcagatgacg

SEQ ID NO: 109671 - DNA, 25 bp, mus musculus
tgcaccagggtctacgtccgagagt

SEQ ID NO: 109672 - DNA, 25 bp, mus musculus
accagggtctacgtccgagagtgag

SEQ ID NO: 109673 - DNA, 25 bp, mus musculus
tgagtgcctacgggtccaagaactg

SEQ ID NO: 109674 - DNA, 25 bp, mus musculus
cctacgggtccaagaactgcctgag

SEQ ID NO: 109675 - DNA, 25 bp, mus musculus
ccaagaactgcctgagacgacttcc

SEQ ID NO: 109676 - DNA, 25 bp, mus musculus
agaactgcctgagacgacttccgtg

SEQ ID NO: 109677 - DNA, 25 bp, mus musculus
gcctgagacgacttccgtgcccgct

SEQ ID NO: 109678 - DNA, 25 bp, mus musculus
gcctgcagtggacttcaacatatgg

SEQ ID NO: 109679 - DNA, 25 bp, mus musculus
cttcaacatatggcctgggagttct

SEQ ID NO: 109680 - DNA, 25 bp, mus musculus
cagctggtctcatcattggtgggaa

SEQ ID NO: 109681 - DNA, 25 bp, mus musculus
gtctcatcattggtgggaaggatct

SEQ ID NO: 109682 - DNA, 25 bp, mus musculus
ggatcaacaacataaacatactggt

SEQ ID NO: 109683 - DNA, 25 bp, mus musculus
acaacataaacatactggtttgcac

SEQ ID NO: 109684 - DNA, 25 bp, mus musculus
taaacatactggtttgcacaccagg

SEQ ID NO: 109685 - DNA, 25 bp, mus musculus
tactggtttgcacaccaggtcgact

SEQ ID NO: 109686 - DNA, 25 bp, mus musculus
tttgcacaccaggtcgacttcttca

SEQ ID NO: 109687 - DNA, 25 bp, mus musculus
caccaggtcgacttcttcaacacat

SEQ ID NO: 109688 - DNA, 25 bp, mus musculus
gtcgacttcttcaacacatggatgt

SEQ ID NO: 109689 - DNA, 25 bp, mus musculus
ttcttcaacacatggatgtaacaat

SEQ ID NO: 109690 - DNA, 25 bp, mus musculus
catatggcctgggagttctgataat

SEQ ID NO: 109691 - DNA, 25 bp, mus musculus
tgataatatcacctactcgagaact

SEQ ID NO: 109692 - DNA, 25 bp, mus musculus
tatcacctactcgagaactggccta

SEQ ID NO: 109693 - DNA, 25 bp, mus musculus
ctactcgagaactggcctatcatac

SEQ ID NO: 109694 - DNA, 25 bp, mus musculus
gagaactggcctatcatacatttga

SEQ ID NO: 109695 - DNA, 25 bp, mus musculus
tggcctatcatacatttgaggttct

SEQ ID NO: 109696 - DNA, 25 bp, mus musculus
atcatgatttttcagctggtctcat

SEQ ID NO: 109697 - DNA, 25 bp, mus musculus
atttttcagctggtctcatcattgg

SEQ ID NO: 109698 - DNA, 25 bp, mus musculus
tctctctgcaacgcagcgtgcgacc

SEQ ID NO: 109699 - DNA, 25 bp, mus musculus
tctctgcaacgcagcgtgcgacccg

SEQ ID NO: 109700 - DNA, 25 bp, mus musculus
atccgccaagacggggatcagttct

SEQ ID NO: 109701 - DNA, 25 bp, mus musculus
ggatcagttctacatcaagacatcc

SEQ ID NO: 109702 - DNA, 25 bp, mus musculus
gatcagttctacatcaagacatcca

SEQ ID NO: 109703 - DNA, 25 bp, mus musculus
atcagttctacatcaagacatccac

SEQ ID NO: 109704 - DNA, 25 bp, mus musculus
cagttctacatcaagacatccacta

SEQ ID NO: 109705 - DNA, 25 bp, mus musculus
agttctacatcaagacatccactac

SEQ ID NO: 109706 - DNA, 25 bp, mus musculus
gttctacatcaagacatccactact

SEQ ID NO: 109707 - DNA, 25 bp, mus musculus
tcaagacatccactactgtgcgcac

SEQ ID NO: 109708 - DNA, 25 bp, mus musculus
aagacatccactactgtgcgcacca

SEQ ID NO: 109709 - DNA, 25 bp, mus musculus
agacatccactactgtgcgcaccac

SEQ ID NO: 109710 - DNA, 25 bp, mus musculus
tctgcaacgcagcgtgcgacccgtc

SEQ ID NO: 109711 - DNA, 25 bp, mus musculus
aagatgcgcagcagcgagaatttcg

SEQ ID NO: 109712 - DNA, 25 bp, mus musculus
tgtgaacgccatgctgaggaaggtg

SEQ ID NO: 109713 - DNA, 25 bp, mus musculus
cggctgcgtctaagccgcacgtgga

SEQ ID NO: 109714 - DNA, 25 bp, mus musculus
taagccgcacgtggagatccgccaa

SEQ ID NO: 109715 - DNA, 25 bp, mus musculus
agccgcacgtggagatccgccaaga

SEQ ID NO: 109716 - DNA, 25 bp, mus musculus
ccgcacgtggagatccgccaagacg

SEQ ID NO: 109717 - DNA, 25 bp, mus musculus
gatccgccaagacggggatcagttc

SEQ ID NO: 109718 - DNA, 25 bp, mus musculus
tcggcctgtgacagcgcgacgagcg

SEQ ID NO: 109719 - DNA, 25 bp, mus musculus
ctcccgatcggacggatgtatgaca

SEQ ID NO: 109720 - DNA, 25 bp, mus musculus
catctctaagaccaagcaagtgatc

SEQ ID NO: 109721 - DNA, 25 bp, mus musculus
agaccaagcaagtgatccaggggct

SEQ ID NO: 109722 - DNA, 25 bp, mus musculus
gaatgagcacaactccatcctgcag

SEQ ID NO: 109723 - DNA, 25 bp, mus musculus
atgagcacaactccatcctgcagag

SEQ ID NO: 109724 - DNA, 25 bp, mus musculus
aactccatcctgcagagtttgctgg

SEQ ID NO: 109725 - DNA, 25 bp, mus musculus
ctccatcctgcagagtttgctggag

SEQ ID NO: 109726 - DNA, 25 bp, mus musculus
ccatcctgcagagtttgctggagac

SEQ ID NO: 109727 - DNA, 25 bp, mus musculus
atcctgcagagtttgctggagacgc

SEQ ID NO: 109728 - DNA, 25 bp, mus musculus
gagtttgctggagacgctgaagtgc

SEQ ID NO: 109729 - DNA, 25 bp, mus musculus
gtttgctggagacgctgaagtgctt

SEQ ID NO: 109730 - DNA, 25 bp, mus musculus
cccgatcggacggatgtatgacaac

SEQ ID NO: 109731 - DNA, 25 bp, mus musculus
aacatgtccaccatggtgtacataa

SEQ ID NO: 109732 - DNA, 25 bp, mus musculus
catgtccaccatggtgtacataaag

SEQ ID NO: 109733 - DNA, 25 bp, mus musculus
tccaccatggtgtacataaaggaag

SEQ ID NO: 109734 - DNA, 25 bp, mus musculus
aagctcacgcaggatgagatcatct

SEQ ID NO: 109735 - DNA, 25 bp, mus musculus
tgagatcatctctaagaccaagcaa

SEQ ID NO: 109736 - DNA, 25 bp, mus musculus
agatcatctctaagaccaagcaagt

SEQ ID NO: 109737 - DNA, 25 bp, mus musculus
atcatctctaagaccaagcaagtga

SEQ ID NO: 109738 - DNA, 25 bp, mus musculus
gaccactgatggacagcagattcta

SEQ ID NO: 109739 - DNA, 25 bp, mus musculus
cgatgtacaaacataccagatccgc

SEQ ID NO: 109740 - DNA, 25 bp, mus musculus
ttactgccacaaatcagattaattt

SEQ ID NO: 109741 - DNA, 25 bp, mus musculus
tttttctatgcgcaaaactgcctga

SEQ ID NO: 109742 - DNA, 25 bp, mus musculus
ttctatgcgcaaaactgcctgaaag

SEQ ID NO: 109743 - DNA, 25 bp, mus musculus
aaagcaactacagaatttcattcat

SEQ ID NO: 109744 - DNA, 25 bp, mus musculus
tcatttctgcttttgcattaaactg

SEQ ID NO: 109745 - DNA, 25 bp, mus musculus
tttctgcttttgcattaaactgtga

SEQ ID NO: 109746 - DNA, 25 bp, mus musculus
acttctgccctcaagaaatgtgcag

SEQ ID NO: 109747 - DNA, 25 bp, mus musculus
tctgccctcaagaaatgtgcagcgc

SEQ ID NO: 109748 - DNA, 25 bp, mus musculus
aaatgtgcagcgccaggaatcatga

SEQ ID NO: 109749 - DNA, 25 bp, mus musculus
tgtgcagcgccaggaatcatgaaga

SEQ ID NO: 109750 - DNA, 25 bp, mus musculus
gagcaccattgcccctggagttgtt

SEQ ID NO: 109751 - DNA, 25 bp, mus musculus
cattgcccctggagttgttatggcg

SEQ ID NO: 109752 - DNA, 25 bp, mus musculus
tgcccctggagttgttatggcgtcc

SEQ ID NO: 109753 - DNA, 25 bp, mus musculus
acttcctacacagcctgctgaagaa

SEQ ID NO: 109754 - DNA, 25 bp, mus musculus
tcctacacagcctgctgaagaagca

SEQ ID NO: 109755 - DNA, 25 bp, mus musculus
tacacagcctgctgaagaagcagca

SEQ ID NO: 109756 - DNA, 25 bp, mus musculus
ggacctttactgccacaaatcagat

SEQ ID NO: 109757 - DNA, 25 bp, mus musculus
cctttactgccacaaatcagattaa

SEQ ID NO: 109758 - DNA, 25 bp, mus musculus
gtctgtgaactggacctggtgttca

SEQ ID NO: 109759 - DNA, 25 bp, mus musculus
ctgtgaactggacctggtgttcaac

SEQ ID NO: 109760 - DNA, 25 bp, mus musculus
tccgagagaccagccagacgaaggt

SEQ ID NO: 109761 - DNA, 25 bp, mus musculus
agagaccagccagacgaaggtgctg

SEQ ID NO: 109762 - DNA, 25 bp, mus musculus
agaccagccagacgaaggtgctgaa

SEQ ID NO: 109763 - DNA, 25 bp, mus musculus
accagccagacgaaggtgctgaagc

SEQ ID NO: 109764 - DNA, 25 bp, mus musculus
cagccagacgaaggtgctgaagcag

SEQ ID NO: 109765 - DNA, 25 bp, mus musculus
gaagcagctgctgatgctgcagtcc

SEQ ID NO: 109766 - DNA, 25 bp, mus musculus
ctgatgctgcagtccctggagtgag

SEQ ID NO: 109767 - DNA, 25 bp, mus musculus
tgctggaccaacctgcctgctcgtc

SEQ ID NO: 109768 - DNA, 25 bp, mus musculus
cccttcctcagctggcccagaggaa

SEQ ID NO: 109769 - DNA, 25 bp, mus musculus
cagctggcccagaggaaggacccgg

SEQ ID NO: 109770 - DNA, 25 bp, mus musculus
gaactggacctggtgttcaacttct

SEQ ID NO: 109771 - DNA, 25 bp, mus musculus
caaggtttacacggtggtagatgag

SEQ ID NO: 109772 - DNA, 25 bp, mus musculus
gtttacacggtggtagatgagatgt

SEQ ID NO: 109773 - DNA, 25 bp, mus musculus
atgagatgttcctggcaggagagat

SEQ ID NO: 109774 - DNA, 25 bp, mus musculus
gagatgttcctggcaggagagatcc

SEQ ID NO: 109775 - DNA, 25 bp, mus musculus
gatgttcctggcaggagagatccga

SEQ ID NO: 109776 - DNA, 25 bp, mus musculus
ttcctggcaggagagatccgagaga

SEQ ID NO: 109777 - DNA, 25 bp, mus musculus
gatccgagagaccagccagacgaag

SEQ ID NO: 109778 - DNA, 25 bp, mus musculus
tggcttcagagatcctgggcctcag

SEQ ID NO: 109779 - DNA, 25 bp, mus musculus
cagagatcctgggcctcagctacgc

SEQ ID NO: 109780 - DNA, 25 bp, mus musculus
atgtcagcacagattccttctctga

SEQ ID NO: 109781 - DNA, 25 bp, mus musculus
attccttctctgaacacaggcagct

SEQ ID NO: 109782 - DNA, 25 bp, mus musculus
tctctgaacacaggcagctttctag

SEQ ID NO: 109783 - DNA, 25 bp, mus musculus
aacacaggcagctttctagaagttt

SEQ ID NO: 109784 - DNA, 25 bp, mus musculus
ccaccttcttatccatggggcacaa

SEQ ID NO: 109785 - DNA, 25 bp, mus musculus
tcttatccatggggcacaactgcaa

SEQ ID NO: 109786 - DNA, 25 bp, mus musculus
ggcacaactgcaataacttctgacc

SEQ ID NO: 109787 - DNA, 25 bp, mus musculus
gcgaaagccgagaactcctgactat

SEQ ID NO: 109788 - DNA, 25 bp, mus musculus
gccgagaactcctgactattaagat

SEQ ID NO: 109789 - DNA, 25 bp, mus musculus
aactcctgactattaagatattcca

SEQ ID NO: 109790 - DNA, 25 bp, mus musculus
ctggaggccatcttccagagaagac

SEQ ID NO: 109791 - DNA, 25 bp, mus musculus
gggccagccatggcttcaaggccag

SEQ ID NO: 109792 - DNA, 25 bp, mus musculus
gcttcaaggccagactgctgctcga

SEQ ID NO: 109793 - DNA, 25 bp, mus musculus
aggccagactgctgctcgagtaggg

SEQ ID NO: 109794 - DNA, 25 bp, mus musculus
tgctcgagtagggctgcttccagcc

SEQ ID NO: 109795 - DNA, 25 bp, mus musculus
gctgcttccagccacagagcccagg

SEQ ID NO: 109796 - DNA, 25 bp, mus musculus
gccctggacacttctgcagggcagc

SEQ ID NO: 109797 - DNA, 25 bp, mus musculus
tctgcagggcagccctgaatgtcag

SEQ ID NO: 109798 - DNA, 25 bp, mus musculus
attcggaacgaggctggtgctgacc

SEQ ID NO: 109799 - DNA, 25 bp, mus musculus
aggctggtgctgaccatctttgcta

SEQ ID NO: 109800 - DNA, 25 bp, mus musculus
tattcgctttgagtggaagggcttc

SEQ ID NO: 109801 - DNA, 25 bp, mus musculus
aagggcttcaagctggtggcactga

SEQ ID NO: 109802 - DNA, 25 bp, mus musculus
ttcaagctggtggcactgagcctgc

SEQ ID NO: 109803 - DNA, 25 bp, mus musculus
actgagcctgctgcaggcctccgaa

SEQ ID NO: 109804 - DNA, 25 bp, mus musculus
agcctgctgcaggcctccgaagagc

SEQ ID NO: 109805 - DNA, 25 bp, mus musculus
gcctccgaagagctactgcgagaca

SEQ ID NO: 109806 - DNA, 25 bp, mus musculus
ctccgaagagctactgcgagacatg

SEQ ID NO: 109807 - DNA, 25 bp, mus musculus
agctactgcgagacatgtatgtcga

SEQ ID NO: 109808 - DNA, 25 bp, mus musculus
ctactgcgagacatgtatgtcgagc

SEQ ID NO: 109809 - DNA, 25 bp, mus musculus
atgtatgtcgagctgcacgagaaac

SEQ ID NO: 109810 - DNA, 25 bp, mus musculus
gctggtgctgaccatctttgctaac

SEQ ID NO: 109811 - DNA, 25 bp, mus musculus
gtgctgaccatctttgctaacctct

SEQ ID NO: 109812 - DNA, 25 bp, mus musculus
gctgaccatctttgctaacctcttc

SEQ ID NO: 109813 - DNA, 25 bp, mus musculus
ggcatgcctgaagccagtactcccg

SEQ ID NO: 109814 - DNA, 25 bp, mus musculus
tgcctgaagccagtactcccgcagc

SEQ ID NO: 109815 - DNA, 25 bp, mus musculus
tgaagccagtactcccgcagcctac

SEQ ID NO: 109816 - DNA, 25 bp, mus musculus
gatagctattcgctttgagtggaag

SEQ ID NO: 109817 - DNA, 25 bp, mus musculus
tagctattcgctttgagtggaaggg

SEQ ID NO: 109818 - DNA, 25 bp, mus musculus
cagagcctacaacctacttccttct

SEQ ID NO: 109819 - DNA, 25 bp, mus musculus
gagcctacaacctacttccttctag

SEQ ID NO: 109820 - DNA, 25 bp, mus musculus
ggccttgtccctagacagcagggct

SEQ ID NO: 109821 - DNA, 25 bp, mus musculus
gccttgtccctagacagcagggctc

SEQ ID NO: 109822 - DNA, 25 bp, mus musculus
ccttgtccctagacagcagggctct

SEQ ID NO: 109823 - DNA, 25 bp, mus musculus
cttgtccctagacagcagggctctc

SEQ ID NO: 109824 - DNA, 25 bp, mus musculus
ttgtccctagacagcagggctctcc

SEQ ID NO: 109825 - DNA, 25 bp, mus musculus
tgtccctagacagcagggctctccg

SEQ ID NO: 109826 - DNA, 25 bp, mus musculus
gtccctagacagcagggctctccgc

SEQ ID NO: 109827 - DNA, 25 bp, mus musculus
tccctagacagcagggctctccgca

SEQ ID NO: 109828 - DNA, 25 bp, mus musculus
ccctagacagcagggctctccgcag

SEQ ID NO: 109829 - DNA, 25 bp, mus musculus
cctagacagcagggctctccgcagc

SEQ ID NO: 109830 - DNA, 25 bp, mus musculus
gcctacaacctacttccttctagct

SEQ ID NO: 109831 - DNA, 25 bp, mus musculus
caggcgagtgccaggccttgtccct

SEQ ID NO: 109832 - DNA, 25 bp, mus musculus
agtgccaggccttgtccctagacag

SEQ ID NO: 109833 - DNA, 25 bp, mus musculus
gtgccaggccttgtccctagacagc

SEQ ID NO: 109834 - DNA, 25 bp, mus musculus
tgccaggccttgtccctagacagca

SEQ ID NO: 109835 - DNA, 25 bp, mus musculus
gccaggccttgtccctagacagcag

SEQ ID NO: 109836 - DNA, 25 bp, mus musculus
caggccttgtccctagacagcaggg

SEQ ID NO: 109837 - DNA, 25 bp, mus musculus
aggccttgtccctagacagcagggc

SEQ ID NO: 109838 - DNA, 25 bp, mus musculus
cccaagccggaattcatgtctaagt

SEQ ID NO: 109839 - DNA, 25 bp, mus musculus
atgtctaagtctctccaagagctgc

SEQ ID NO: 109840 - DNA, 25 bp, mus musculus
atctttgtacagcaccgagtctccg

SEQ ID NO: 109841 - DNA, 25 bp, mus musculus
tttgtacagcaccgagtctccgcct

SEQ ID NO: 109842 - DNA, 25 bp, mus musculus
gtacagcaccgagtctccgccttac

SEQ ID NO: 109843 - DNA, 25 bp, mus musculus
caccgagtctccgccttacctgtag

SEQ ID NO: 109844 - DNA, 25 bp, mus musculus
gtctccgccttacctgtagtggatg

SEQ ID NO: 109845 - DNA, 25 bp, mus musculus
gacatctactccaagtttgatgtga

SEQ ID NO: 109846 - DNA, 25 bp, mus musculus
tactccaagtttgatgtgatcaatt

SEQ ID NO: 109847 - DNA, 25 bp, mus musculus
atcaatttggcagccgaaaagacct

SEQ ID NO: 109848 - DNA, 25 bp, mus musculus
aagacctacaacaacctagatgtgt

SEQ ID NO: 109849 - DNA, 25 bp, mus musculus
tctgtgacaaaagccctgcagcatc

SEQ ID NO: 109850 - DNA, 25 bp, mus musculus
aagtctctccaagagctgcagattg

SEQ ID NO: 109851 - DNA, 25 bp, mus musculus
tctctccaagagctgcagattggca

SEQ ID NO: 109852 - DNA, 25 bp, mus musculus
ggcacctatgccaatattgccatgg

SEQ ID NO: 109853 - DNA, 25 bp, mus musculus
acctatgccaatattgccatggtcc

SEQ ID NO: 109854 - DNA, 25 bp, mus musculus
tatgccaatattgccatggtccgta

SEQ ID NO: 109855 - DNA, 25 bp, mus musculus
attgccatggtccgtactaccacgc

SEQ ID NO: 109856 - DNA, 25 bp, mus musculus
gccatggtccgtactaccacgcctg

SEQ ID NO: 109857 - DNA, 25 bp, mus musculus
gtccgtactaccacgcctgtctacg

SEQ ID NO: 109858 - DNA, 25 bp, mus musculus
acagacaagatgcttccccgtataa

SEQ ID NO: 109859 - DNA, 25 bp, mus musculus
aagatgcttccccgtataaccatca

SEQ ID NO: 109860 - DNA, 25 bp, mus musculus
gtgcctatggtcctattgctatgcc

SEQ ID NO: 109861 - DNA, 25 bp, mus musculus
cctatggtcctattgctatgccttg

SEQ ID NO: 109862 - DNA, 25 bp, mus musculus
gtcctattgctatgccttgtttagt

SEQ ID NO: 109863 - DNA, 25 bp, mus musculus
ctattgctatgccttgtttagtgta

SEQ ID NO: 109864 - DNA, 25 bp, mus musculus
tatggcctgccaaaagaggccctca

SEQ ID NO: 109865 - DNA, 25 bp, mus musculus
gaggccctcaggacatcttgtgtct

SEQ ID NO: 109866 - DNA, 25 bp, mus musculus
gtctgtgctcagtggcgctgaagct

SEQ ID NO: 109867 - DNA, 25 bp, mus musculus
gctcagtggcgctgaagcttccttc

SEQ ID NO: 109868 - DNA, 25 bp, mus musculus
cttcctgtcctccatgatcaaaagc

SEQ ID NO: 109869 - DNA, 25 bp, mus musculus
cctgtcctccatgatcaaaagcagt

SEQ ID NO: 109870 - DNA, 25 bp, mus musculus
atgcttccccgtataaccatcacca

SEQ ID NO: 109871 - DNA, 25 bp, mus musculus
gtcctccatgatcaaaagcagtggt

SEQ ID NO: 109872 - DNA, 25 bp, mus musculus
cgtataaccatcaccatcatgtcct

SEQ ID NO: 109873 - DNA, 25 bp, mus musculus
ataaccatcaccatcatgtcctgga

SEQ ID NO: 109874 - DNA, 25 bp, mus musculus
accatcaccatcatgtcctggatgc

SEQ ID NO: 109875 - DNA, 25 bp, mus musculus
ctttctcaggtgcaaggtgaagttg

SEQ ID NO: 109876 - DNA, 25 bp, mus musculus
gatgccccatcttcacgtagcagct

SEQ ID NO: 109877 - DNA, 25 bp, mus musculus
tcacgtagcagctgccccaagggtc

SEQ ID NO: 109878 - DNA, 25 bp, mus musculus
cccgtgcctatggtcctattgctat

SEQ ID NO: 109879 - DNA, 25 bp, mus musculus
tgacaagtggcccgtgtctgtccga

SEQ ID NO: 109880 - DNA, 25 bp, mus musculus
cgtgtctgtccgagcaaatggacac

SEQ ID NO: 109881 - DNA, 25 bp, mus musculus
agctgacggaatgcgcctggctctg

SEQ ID NO: 109882 - DNA, 25 bp, mus musculus
cggaatgcgcctggctctggctgat

SEQ ID NO: 109883 - DNA, 25 bp, mus musculus
gcgcctggctctggctgatgctggt

SEQ ID NO: 109884 - DNA, 25 bp, mus musculus
tgctggtgacactgttgaagatgct

SEQ ID NO: 109885 - DNA, 25 bp, mus musculus
agatgctaactttgtggaagccatg

SEQ ID NO: 109886 - DNA, 25 bp, mus musculus
agccatggcagacgcaggcatcctc

SEQ ID NO: 109887 - DNA, 25 bp, mus musculus
catcctccgtctgtacacatgggta

SEQ ID NO: 109888 - DNA, 25 bp, mus musculus
gtacacatgggtagagtgggtcaaa

SEQ ID NO: 109889 - DNA, 25 bp, mus musculus
cagcagcctcagaagtggacctgcc

SEQ ID NO: 109890 - DNA, 25 bp, mus musculus
cctcagaagtggacctgccgactca

SEQ ID NO: 109891 - DNA, 25 bp, mus musculus
agcaaatggacacctgctgctcaac

SEQ ID NO: 109892 - DNA, 25 bp, mus musculus
aagtggacctgccgactcattcaat

SEQ ID NO: 109893 - DNA, 25 bp, mus musculus
tggacacctgctgctcaactcggag

SEQ ID NO: 109894 - DNA, 25 bp, mus musculus
cctgctgctcaactcggagaagatg

SEQ ID NO: 109895 - DNA, 25 bp, mus musculus
atctacgggcaacttcctcactttg

SEQ ID NO: 109896 - DNA, 25 bp, mus musculus
gggcaacttcctcactttgagccaa

SEQ ID NO: 109897 - DNA, 25 bp, mus musculus
cttcctcactttgagccaagctgtt

SEQ ID NO: 109898 - DNA, 25 bp, mus musculus
cactttgagccaagctgttgacaaa

SEQ ID NO: 109899 - DNA, 25 bp, mus musculus
attttcagctgacggaatgcgcctg

SEQ ID NO: 109900 - DNA, 25 bp, mus musculus
accagagacgggaactctggtcatc

SEQ ID NO: 109901 - DNA, 25 bp, mus musculus
cgggaactctggtcatcctgtgccg

SEQ ID NO: 109902 - DNA, 25 bp, mus musculus
gtgccgacactgtagagagtcttgc

SEQ ID NO: 109903 - DNA, 25 bp, mus musculus
cacttctactgcacacacatagagc

SEQ ID NO: 109904 - DNA, 25 bp, mus musculus
acttctactgcacacacatagagca

SEQ ID NO: 109905 - DNA, 25 bp, mus musculus
cttctactgcacacacatagagcag

SEQ ID NO: 109906 - DNA, 25 bp, mus musculus
ttctactgcacacacatagagcaga

SEQ ID NO: 109907 - DNA, 25 bp, mus musculus
tctactgcacacacatagagcagaa

SEQ ID NO: 109908 - DNA, 25 bp, mus musculus
ctactgcacacacatagagcagaag

SEQ ID NO: 109909 - DNA, 25 bp, mus musculus
tactgcacacacatagagcagaagt

SEQ ID NO: 109910 - DNA, 25 bp, mus musculus
actgcacacacatagagcagaagtg

SEQ ID NO: 109911 - DNA, 25 bp, mus musculus
ctgcacacacatagagcagaagtgc

SEQ ID NO: 109912 - DNA, 25 bp, mus musculus
aactctggtcatcctgtgccgacac

SEQ ID NO: 109913 - DNA, 25 bp, mus musculus
actctggtcatcctgtgccgacact

SEQ ID NO: 109914 - DNA, 25 bp, mus musculus
catcctgtgccgacactgtagagag

SEQ ID NO: 109915 - DNA, 25 bp, mus musculus
atcctgtgccgacactgtagagagt

SEQ ID NO: 109916 - DNA, 25 bp, mus musculus
tcctgtgccgacactgtagagagtc

SEQ ID NO: 109917 - DNA, 25 bp, mus musculus
cctgtgccgacactgtagagagtct

SEQ ID NO: 109918 - DNA, 25 bp, mus musculus
ctgtgccgacactgtagagagtctt

SEQ ID NO: 109919 - DNA, 25 bp, mus musculus
tgtgccgacactgtagagagtcttg

SEQ ID NO: 109920 - DNA, 25 bp, mus musculus
cttgtttcggaaggagctgactggc

SEQ ID NO: 109921 - DNA, 25 bp, mus musculus
tttcggaaggagctgactggccaat

SEQ ID NO: 109922 - DNA, 25 bp, mus musculus
gtgcatactctttcggaccaggtcc

SEQ ID NO: 109923 - DNA, 25 bp, mus musculus
catactctttcggaccaggtccagg

SEQ ID NO: 109924 - DNA, 25 bp, mus musculus
agctccaaagtcaccaaggaactga

SEQ ID NO: 109925 - DNA, 25 bp, mus musculus
ctccaaagtcaccaaggaactgacg

SEQ ID NO: 109926 - DNA, 25 bp, mus musculus
agtcaccaaggaactgacggcactt

SEQ ID NO: 109927 - DNA, 25 bp, mus musculus
gtcaccaaggaactgacggcacttg

SEQ ID NO: 109928 - DNA, 25 bp, mus musculus
caaggaactgacggcacttgttgga

SEQ ID NO: 109929 - DNA, 25 bp, mus musculus
actgacggcacttgttggagggcac

SEQ ID NO: 109930 - DNA, 25 bp, mus musculus
ctgacggcacttgttggagggcacc

SEQ ID NO: 109931 - DNA, 25 bp, mus musculus
acggcacttgttggagggcacctat

SEQ ID NO: 109932 - DNA, 25 bp, mus musculus
agatcagctcgagttgcagtgcaaa

SEQ ID NO: 109933 - DNA, 25 bp, mus musculus
atcagctcgagttgcagtgcaaacg

SEQ ID NO: 109934 - DNA, 25 bp, mus musculus
agctcgagttgcagtgcaaacggac

SEQ ID NO: 109935 - DNA, 25 bp, mus musculus
tgaaaccggtgtctgggattacctg

SEQ ID NO: 109936 - DNA, 25 bp, mus musculus
tacctgcactgggtgcatactcttt

SEQ ID NO: 109937 - DNA, 25 bp, mus musculus
cctgcactgggtgcatactctttcg

SEQ ID NO: 109938 - DNA, 25 bp, mus musculus
ctgcactgggtgcatactctttcgg

SEQ ID NO: 109939 - DNA, 25 bp, mus musculus
ggtgcatactctttcggaccaggtc

SEQ ID NO: 109940 - DNA, 25 bp, mus musculus
aagttcttcagccaagcacagtggt

SEQ ID NO: 109941 - DNA, 25 bp, mus musculus
ttcttcagccaagcacagtggtgca

SEQ ID NO: 109942 - DNA, 25 bp, mus musculus
cccaaacacctgagtctcttttctg

SEQ ID NO: 109943 - DNA, 25 bp, mus musculus
cgaaggctttctccaagctatatac

SEQ ID NO: 109944 - DNA, 25 bp, mus musculus
aggctttctccaagctatatacaat

SEQ ID NO: 109945 - DNA, 25 bp, mus musculus
ctttctccaagctatatacaattat

SEQ ID NO: 109946 - DNA, 25 bp, mus musculus
tatatacaattattcaactgttgtg

SEQ ID NO: 109947 - DNA, 25 bp, mus musculus
ttattcaactgttgtggaggaaaga

SEQ ID NO: 109948 - DNA, 25 bp, mus musculus
aatccaggtcgcaactgagacgaaa

SEQ ID NO: 109949 - DNA, 25 bp, mus musculus
aggcggttccagctggcgtgcagat

SEQ ID NO: 109950 - DNA, 25 bp, mus musculus
cggttccagctggcgtgcagataga

SEQ ID NO: 109951 - DNA, 25 bp, mus musculus
ttccagctggcgtgcagatagaaaa

SEQ ID NO: 109952 - DNA, 25 bp, mus musculus
ttcagccaagcacagtggtgcacac

SEQ ID NO: 109953 - DNA, 25 bp, mus musculus
acactattaacgtcagctctcagga

SEQ ID NO: 109954 - DNA, 25 bp, mus musculus
acgtcagctctcaggaggctacaac

SEQ ID NO: 109955 - DNA, 25 bp, mus musculus
gactactaaaagctcatgtccaacc

SEQ ID NO: 109956 - DNA, 25 bp, mus musculus
agtaccaggccaacaaagactgaat

SEQ ID NO: 109957 - DNA, 25 bp, mus musculus
gaatggcaagaccctcacagcaaac

SEQ ID NO: 109958 - DNA, 25 bp, mus musculus
tggcaagaccctcacagcaaaccca

SEQ ID NO: 109959 - DNA, 25 bp, mus musculus
cacagcaaacccaaacacctgagtc

SEQ ID NO: 109960 - DNA, 25 bp, mus musculus
ccagaaatttgccagcagtgggacc

SEQ ID NO: 109961 - DNA, 25 bp, mus musculus
gaaatttgccagcagtgggaccctg

SEQ ID NO: 109962 - DNA, 25 bp, mus musculus
gcacattcgtactcacaccagggag

SEQ ID NO: 109963 - DNA, 25 bp, mus musculus
cattcgtactcacaccagggagaag

SEQ ID NO: 109964 - DNA, 25 bp, mus musculus
tcgtactcacaccagggagaagccc

SEQ ID NO: 109965 - DNA, 25 bp, mus musculus
gccctaccagtgctcagagtgcagc

SEQ ID NO: 109966 - DNA, 25 bp, mus musculus
ctaccagtgctcagagtgcagcaag

SEQ ID NO: 109967 - DNA, 25 bp, mus musculus
gtgctcagagtgcagcaaggccttc

SEQ ID NO: 109968 - DNA, 25 bp, mus musculus
cagcaaggccttcagccagaagcgg

SEQ ID NO: 109969 - DNA, 25 bp, mus musculus
cagccagaagcggggcctcgatgaa

SEQ ID NO: 109970 - DNA, 25 bp, mus musculus
aaagccttttcagtgtgacgtatgt

SEQ ID NO: 109971 - DNA, 25 bp, mus musculus
gccttttcagtgtgacgtatgtgac

SEQ ID NO: 109972 - DNA, 25 bp, mus musculus
cctgagagttcacatccggagccac

SEQ ID NO: 109973 - DNA, 25 bp, mus musculus
tgacttggcttttagcatgaagaaa

SEQ ID NO: 109974 - DNA, 25 bp, mus musculus
tcacatccggagccacacaggtgag

SEQ ID NO: 109975 - DNA, 25 bp, mus musculus
ccacacaggtgagcgcccctatcaa

SEQ ID NO: 109976 - DNA, 25 bp, mus musculus
cacaggtgagcgcccctatcaatgc

SEQ ID NO: 109977 - DNA, 25 bp, mus musculus
aggtgagcgcccctatcaatgcccg

SEQ ID NO: 109978 - DNA, 25 bp, mus musculus
gcgcccctatcaatgcccgtactgt

SEQ ID NO: 109979 - DNA, 25 bp, mus musculus
cccctatcaatgcccgtactgtgaa

SEQ ID NO: 109980 - DNA, 25 bp, mus musculus
ctatcaatgcccgtactgtgaaaaa

SEQ ID NO: 109981 - DNA, 25 bp, mus musculus
tcacctgggctacatcctcacatgc

SEQ ID NO: 109982 - DNA, 25 bp, mus musculus
gcaccggactgcgggcaggtgtaca

SEQ ID NO: 109983 - DNA, 25 bp, mus musculus
caacggctcgagcagggtcaggcaa

SEQ ID NO: 109984 - DNA, 25 bp, mus musculus
acggctcgagcagggtcaggcaatc

SEQ ID NO: 109985 - DNA, 25 bp, mus musculus
ggctcgagcagggtcaggcaatcga

SEQ ID NO: 109986 - DNA, 25 bp, mus musculus
caatcgatgacctcatgccggccca

SEQ ID NO: 109987 - DNA, 25 bp, mus musculus
cgctgagcccttagcctcgctgtag

SEQ ID NO: 109988 - DNA, 25 bp, mus musculus
ctgagcccttagcctcgctgtagag

SEQ ID NO: 109989 - DNA, 25 bp, mus musculus
gagcccttagcctcgctgtagagac

SEQ ID NO: 109990 - DNA, 25 bp, mus musculus
ttttttgatggctaagctgttgctg

SEQ ID NO: 109991 - DNA, 25 bp, mus musculus
gatggctaagctgttgctgacactg

SEQ ID NO: 109992 - DNA, 25 bp, mus musculus
taagctgttgctgacactgaaaata

SEQ ID NO: 109993 - DNA, 25 bp, mus musculus
accggactgcgggcaggtgtacaca

SEQ ID NO: 109994 - DNA, 25 bp, mus musculus
agaagttctcggaggtgctcaagcg

SEQ ID NO: 109995 - DNA, 25 bp, mus musculus
gttctcggaggtgctcaagcggctg

SEQ ID NO: 109996 - DNA, 25 bp, mus musculus
tctcggaggtgctcaagcggctgcg

SEQ ID NO: 109997 - DNA, 25 bp, mus musculus
gtgctcaagcggctgcggcttcaga

SEQ ID NO: 109998 - DNA, 25 bp, mus musculus
gctcaagcggctgcggcttcagaag

SEQ ID NO: 109999 - DNA, 25 bp, mus musculus
ctgcggcttcagaagcgaggcacag

SEQ ID NO: 110000 - DNA, 25 bp, mus musculus
tctccaacgctgaccgcctgggctt

SEQ ID NO: 110001 - DNA, 25 bp, mus musculus
ccttctacctagatgttctacctgt

SEQ ID NO: 110002 - DNA, 25 bp, mus musculus
tagatgttctacctgttgagtagag

SEQ ID NO: 110003 - DNA, 25 bp, mus musculus
tcattcactaattcatttaacataa

SEQ ID NO: 110004 - DNA, 25 bp, mus musculus
ttcactaattcatttaacataaatt

SEQ ID NO: 110005 - DNA, 25 bp, mus musculus
aattcattcattgtgtaccaattgg

SEQ ID NO: 110006 - DNA, 25 bp, mus musculus
agactaattacctctaggagataca

SEQ ID NO: 110007 - DNA, 25 bp, mus musculus
ctaattacctctaggagatacaaat

SEQ ID NO: 110008 - DNA, 25 bp, mus musculus
attacctctaggagatacaaataca

SEQ ID NO: 110009 - DNA, 25 bp, mus musculus
tataaacaaaccagagaacactgtc

SEQ ID NO: 110010 - DNA, 25 bp, mus musculus
caaaccagagaacactgtcccagga

SEQ ID NO: 110011 - DNA, 25 bp, mus musculus
gaacactgtcccaggaaaagaatag

SEQ ID NO: 110012 - DNA, 25 bp, mus musculus
ttcttattcccaaaattgaagtgtg

SEQ ID NO: 110013 - DNA, 25 bp, mus musculus
atgttctacctgttgagtagaggga

SEQ ID NO: 110014 - DNA, 25 bp, mus musculus
ttctacctgttgagtagagggatgt

SEQ ID NO: 110015 - DNA, 25 bp, mus musculus
atgttcctgccttcttcagaccttc

SEQ ID NO: 110016 - DNA, 25 bp, mus musculus
ttcctgccttcttcagaccttctgc

SEQ ID NO: 110017 - DNA, 25 bp, mus musculus
ccttcttcagaccttctgctgttcc

SEQ ID NO: 110018 - DNA, 25 bp, mus musculus
tcacctaactgtgcagaatcctatt

SEQ ID NO: 110019 - DNA, 25 bp, mus musculus
cctaactgtgcagaatcctattaaa

SEQ ID NO: 110020 - DNA, 25 bp, mus musculus
ttttcctcaaatacaaatagagatt

SEQ ID NO: 110021 - DNA, 25 bp, mus musculus
tgggctcttggcctgagatttccgc

SEQ ID NO: 110022 - DNA, 25 bp, mus musculus
ctgagatttccgcgggttcagggtg

SEQ ID NO: 110023 - DNA, 25 bp, mus musculus
tccgacagccagcttctctcatatc

SEQ ID NO: 110024 - DNA, 25 bp, mus musculus
agccagcttctctcatatcctcttc

SEQ ID NO: 110025 - DNA, 25 bp, mus musculus
tcatatcctcttcctgtgactttct

SEQ ID NO: 110026 - DNA, 25 bp, mus musculus
cctgtgactttctctactctgtagt

SEQ ID NO: 110027 - DNA, 25 bp, mus musculus
actttctctactctgtagtattgct

SEQ ID NO: 110028 - DNA, 25 bp, mus musculus
ctgtagtattgctcctaaggacctt

SEQ ID NO: 110029 - DNA, 25 bp, mus musculus
tattgctcctaaggaccttggtcat

SEQ ID NO: 110030 - DNA, 25 bp, mus musculus
tcctaaggaccttggtcatccatga

SEQ ID NO: 110031 - DNA, 25 bp, mus musculus
agaatggagcccctggcagacaata

SEQ ID NO: 110032 - DNA, 25 bp, mus musculus
gagcccctggcagacaataaagagc

SEQ ID NO: 110033 - DNA, 25 bp, mus musculus
ggctcaacaccagctggtcggaggg

SEQ ID NO: 110034 - DNA, 25 bp, mus musculus
tgtcttcctggaaagtggcatctaa

SEQ ID NO: 110035 - DNA, 25 bp, mus musculus
catctaaggactgctccagagggca

SEQ ID NO: 110036 - DNA, 25 bp, mus musculus
ggctcaccaactccaagagccctat

SEQ ID NO: 110037 - DNA, 25 bp, mus musculus
ccaactccaagagccctatgctaga

SEQ ID NO: 110038 - DNA, 25 bp, mus musculus
tgctagagcccctgatggcagcctc

SEQ ID NO: 110039 - DNA, 25 bp, mus musculus
ttttgcccatacttactgcactgca

SEQ ID NO: 110040 - DNA, 25 bp, mus musculus
ttactgcactgcagccgccgtgtgc

SEQ ID NO: 110041 - DNA, 25 bp, mus musculus
ttcggcacaggcccgactctacgtg

SEQ ID NO: 110042 - DNA, 25 bp, mus musculus
tcggcacaggcccgactctacgtga

SEQ ID NO: 110043 - DNA, 25 bp, mus musculus
ttaccaccttcttctgtgaaaactg

SEQ ID NO: 110044 - DNA, 25 bp, mus musculus
ccttcttctgtgaaaactgagcctg

SEQ ID NO: 110045 - DNA, 25 bp, mus musculus
aactgagcctggaaaacatgtggtt

SEQ ID NO: 110046 - DNA, 25 bp, mus musculus
tttgaacttgaagccaactgtaact

SEQ ID NO: 110047 - DNA, 25 bp, mus musculus
tgaacttgaagccaactgtaactca

SEQ ID NO: 110048 - DNA, 25 bp, mus musculus
acttgaagccaactgtaactcatgg

SEQ ID NO: 110049 - DNA, 25 bp, mus musculus
cttgaagccaactgtaactcatgga

SEQ ID NO: 110050 - DNA, 25 bp, mus musculus
tgaagccaactgtaactcatggagt

SEQ ID NO: 110051 - DNA, 25 bp, mus musculus
gaagccaactgtaactcatggagtt

SEQ ID NO: 110052 - DNA, 25 bp, mus musculus
gccaactgtaactcatggagttccg

SEQ ID NO: 110053 - DNA, 25 bp, mus musculus
ggcacaggcccgactctacgtgaga

SEQ ID NO: 110054 - DNA, 25 bp, mus musculus
gcacaggcccgactctacgtgagac

SEQ ID NO: 110055 - DNA, 25 bp, mus musculus
caggcccgactctacgtgagacgta

SEQ ID NO: 110056 - DNA, 25 bp, mus musculus
ggcccgactctacgtgagacgtaca

SEQ ID NO: 110057 - DNA, 25 bp, mus musculus
gcccgactctacgtgagacgtacag

SEQ ID NO: 110058 - DNA, 25 bp, mus musculus
actctacgtgagacgtacagcccaa

SEQ ID NO: 110059 - DNA, 25 bp, mus musculus
ctctacgtgagacgtacagcccaaa

SEQ ID NO: 110060 - DNA, 25 bp, mus musculus
gactctttaccaccttcttctgtga

SEQ ID NO: 110061 - DNA, 25 bp, mus musculus
aaccatgatgctgccattttcccag

SEQ ID NO: 110062 - DNA, 25 bp, mus musculus
gccattttcccaggaggctttggag

SEQ ID NO: 110063 - DNA, 25 bp, mus musculus
gtcctcgcagccaaagtgatcaaag

SEQ ID NO: 110064 - DNA, 25 bp, mus musculus
ctcgcagccaaagtgatcaaaggtg

SEQ ID NO: 110065 - DNA, 25 bp, mus musculus
gaggtcaccgtaggccatgagcaag

SEQ ID NO: 110066 - DNA, 25 bp, mus musculus
ggcaagtggccttatgctggaactg

SEQ ID NO: 110067 - DNA, 25 bp, mus musculus
ccttatgctggaactgcggaaccat

SEQ ID NO: 110068 - DNA, 25 bp, mus musculus
actgcggaaccatcaaagccctggg

SEQ ID NO: 110069 - DNA, 25 bp, mus musculus
ccatcaaagccctgggtgccaagca

SEQ ID NO: 110070 - DNA, 25 bp, mus musculus
aagccctgggtgccaagcactgtgt

SEQ ID NO: 110071 - DNA, 25 bp, mus musculus
ccctgggtgccaagcactgtgtgaa

SEQ ID NO: 110072 - DNA, 25 bp, mus musculus
gtgccaagcactgtgtgaagggtgt

SEQ ID NO: 110073 - DNA, 25 bp, mus musculus
attttcccaggaggctttggagctg

SEQ ID NO: 110074 - DNA, 25 bp, mus musculus
ccaagcactgtgtgaagggtgtgac

SEQ ID NO: 110075 - DNA, 25 bp, mus musculus
gctgccaaaaacctgagcacattcg

SEQ ID NO: 110076 - DNA, 25 bp, mus musculus
gccaaaaacctgagcacattcgccg

SEQ ID NO: 110077 - DNA, 25 bp, mus musculus
aacctgagcacattcgccgtggacg

SEQ ID NO: 110078 - DNA, 25 bp, mus musculus
ttccacggggccaagaagcccattg

SEQ ID NO: 110079 - DNA, 25 bp, mus musculus
gccaagaagcccattggcttatgct

SEQ ID NO: 110080 - DNA, 25 bp, mus musculus
aagcccattggcttatgctgcatcg

SEQ ID NO: 110081 - DNA, 25 bp, mus musculus
cccattggcttatgctgcatcgctc

SEQ ID NO: 110082 - DNA, 25 bp, mus musculus
tgattgaggtccacggcaagcacga

SEQ ID NO: 110083 - DNA, 25 bp, mus musculus
ttgaggtccacggcaagcacgaaga

SEQ ID NO: 110084 - DNA, 25 bp, mus musculus
aacaggtgtctggccctgagcgcac

SEQ ID NO: 110085 - DNA, 25 bp, mus musculus
ccatcacccgtgaagagaagcctgc

SEQ ID NO: 110086 - DNA, 25 bp, mus musculus
tcgccgcagcccctaagaagtagat

SEQ ID NO: 110087 - DNA, 25 bp, mus musculus
agaagtagatcccctttcctcattg

SEQ ID NO: 110088 - DNA, 25 bp, mus musculus
ggaagtttcccatcagtgattgaaa

SEQ ID NO: 110089 - DNA, 25 bp, mus musculus
agtttcccatcagtgattgaaaatc

SEQ ID NO: 110090 - DNA, 25 bp, mus musculus
ttcccatcagtgattgaaaatctgt

SEQ ID NO: 110091 - DNA, 25 bp, mus musculus
aatctgtgactagtgctgaagctta

SEQ ID NO: 110092 - DNA, 25 bp, mus musculus
aagggctggcccagattattaagct

SEQ ID NO: 110093 - DNA, 25 bp, mus musculus
ggctggcccagattattaagctaat

SEQ ID NO: 110094 - DNA, 25 bp, mus musculus
tccacggcaagcacgaagaacgcca

SEQ ID NO: 110095 - DNA, 25 bp, mus musculus
aacatggcttcatctccagggagtt

SEQ ID NO: 110096 - DNA, 25 bp, mus musculus
atggcttcatctccagggagttcca

SEQ ID NO: 110097 - DNA, 25 bp, mus musculus
gcttcatctccagggagttccacag

SEQ ID NO: 110098 - DNA, 25 bp, mus musculus
tcatctccagggagttccacaggaa

SEQ ID NO: 110099 - DNA, 25 bp, mus musculus
atgtggatcctctcaccatcacttc

SEQ ID NO: 110100 - DNA, 25 bp, mus musculus
atggagtcctcactgtgaatggacc

SEQ ID NO: 110101 - DNA, 25 bp, mus musculus
tcctcactgtgaatggaccaaggaa

SEQ ID NO: 110102 - DNA, 25 bp, mus musculus
tgtggttgctccattcaaatgttct

SEQ ID NO: 110103 - DNA, 25 bp, mus musculus
tccattcaaatgttctgtccttcca

SEQ ID NO: 110104 - DNA, 25 bp, mus musculus
tctgaccaggaacggcgtgtctcat

SEQ ID NO: 110105 - DNA, 25 bp, mus musculus
tggcgtggctttcggcatcactatt

SEQ ID NO: 110106 - DNA, 25 bp, mus musculus
ggctttcggcatcactattgacttt

SEQ ID NO: 110107 - DNA, 25 bp, mus musculus
cggcatcactattgactttgataca

SEQ ID NO: 110108 - DNA, 25 bp, mus musculus
ccacactgcaactctgagggaccga

SEQ ID NO: 110109 - DNA, 25 bp, mus musculus
cactgcaactctgagggaccgagac

SEQ ID NO: 110110 - DNA, 25 bp, mus musculus
aactctgagggaccgagactccatg

SEQ ID NO: 110111 - DNA, 25 bp, mus musculus
ccgagactccatgagacagataagg

SEQ ID NO: 110112 - DNA, 25 bp, mus musculus
agaggtctctgagctgcccaatgtg

SEQ ID NO: 110113 - DNA, 25 bp, mus musculus
ggtctctgagctgcccaatgtggtc

SEQ ID NO: 110114 - DNA, 25 bp, mus musculus
caaatgttctgtccttccactgagc

SEQ ID NO: 110115 - DNA, 25 bp, mus musculus
tgagctgcccaatgtggtccgcgat

SEQ ID NO: 110116 - DNA, 25 bp, mus musculus
ttctgtccttccactgagccagaac

SEQ ID NO: 110117 - DNA, 25 bp, mus musculus
tgtccttccactgagccagaaccaa

SEQ ID NO: 110118 - DNA, 25 bp, mus musculus
ccttccactgagccagaaccaagag

SEQ ID NO: 110119 - DNA, 25 bp, mus musculus
gtttatgccatttgtcaaggaatta

SEQ ID NO: 110120 - DNA, 25 bp, mus musculus
ggaattatccgaagctctgaccagg

SEQ ID NO: 110121 - DNA, 25 bp, mus musculus
attatccgaagctctgaccaggaac

SEQ ID NO: 110122 - DNA, 25 bp, mus musculus
agctctgaccaggaacggcgtgtct

SEQ ID NO: 110123 - DNA, 25 bp, mus musculus
agtagatacatccacttgattgctt

SEQ ID NO: 110124 - DNA, 25 bp, mus musculus
tacatccacttgattgcttctagat

SEQ ID NO: 110125 - DNA, 25 bp, mus musculus
ctttctctacccatcagtcgtcgtc

SEQ ID NO: 110126 - DNA, 25 bp, mus musculus
atcagtcgtcgtctcgcaggaatag

SEQ ID NO: 110127 - DNA, 25 bp, mus musculus
cgtcgtctcgcaggaatagtaaagg

SEQ ID NO: 110128 - DNA, 25 bp, mus musculus
gcatgtacgctgttctaaaagaagt

SEQ ID NO: 110129 - DNA, 25 bp, mus musculus
tctcatttactgttgaacgtttgat

SEQ ID NO: 110130 - DNA, 25 bp, mus musculus
gtttgattacgcaactactttgatt

SEQ ID NO: 110131 - DNA, 25 bp, mus musculus
aactactttgattgtgtacgtgtgt

SEQ ID NO: 110132 - DNA, 25 bp, mus musculus
cgtgtgtacatcccttacagatctg

SEQ ID NO: 110133 - DNA, 25 bp, mus musculus
ccttacagatctgatcaaaaatcgc

SEQ ID NO: 110134 - DNA, 25 bp, mus musculus
gatcaaaaatcgcttttcattttgt

SEQ ID NO: 110135 - DNA, 25 bp, mus musculus
cacttgattgcttctagattcctat

SEQ ID NO: 110136 - DNA, 25 bp, mus musculus
attgcttctagattcctatgtctca

SEQ ID NO: 110137 - DNA, 25 bp, mus musculus
ttcctatgtctcagctgtaagcaag

SEQ ID NO: 110138 - DNA, 25 bp, mus musculus
tgtctcagctgtaagcaagcttgat

SEQ ID NO: 110139 - DNA, 25 bp, mus musculus
tctaaaccctgcagtttgcagctaa

SEQ ID NO: 110140 - DNA, 25 bp, mus musculus
accccactgcagagccgtgtgaatg

SEQ ID NO: 110141 - DNA, 25 bp, mus musculus
tagaaacttcatctttagattaaag

SEQ ID NO: 110142 - DNA, 25 bp, mus musculus
tcaattctgtggctttctctaccca

SEQ ID NO: 110143 - DNA, 25 bp, mus musculus
ttcagccgctgcaactccatccgtg

SEQ ID NO: 110144 - DNA, 25 bp, mus musculus
tcagccgctgcaactccatccgtgt

SEQ ID NO: 110145 - DNA, 25 bp, mus musculus
tgggtttcacgactccatcgctcct

SEQ ID NO: 110146 - DNA, 25 bp, mus musculus
gggtttcacgactccatcgctcctg

SEQ ID NO: 110147 - DNA, 25 bp, mus musculus
atcgctcctgccgttccattccata

SEQ ID NO: 110148 - DNA, 25 bp, mus musculus
tgccgttccattccatacaccagct

SEQ ID NO: 110149 - DNA, 25 bp, mus musculus
gttccattccatacaccagctctca

SEQ ID NO: 110150 - DNA, 25 bp, mus musculus
catacaccagctctcacaggataag

SEQ ID NO: 110151 - DNA, 25 bp, mus musculus
atacaccagctctcacaggataagg

SEQ ID NO: 110152 - DNA, 25 bp, mus musculus
tacaccagctctcacaggataaggc

SEQ ID NO: 110153 - DNA, 25 bp, mus musculus
acaccagctctcacaggataaggct

SEQ ID NO: 110154 - DNA, 25 bp, mus musculus
caccagctctcacaggataaggctt

SEQ ID NO: 110155 - DNA, 25 bp, mus musculus
cagccgctgcaactccatccgtgtg

SEQ ID NO: 110156 - DNA, 25 bp, mus musculus
accagctctcacaggataaggcttt

SEQ ID NO: 110157 - DNA, 25 bp, mus musculus
agccgctgcaactccatccgtgtgg

SEQ ID NO: 110158 - DNA, 25 bp, mus musculus
gccgctgcaactccatccgtgtgga

SEQ ID NO: 110159 - DNA, 25 bp, mus musculus
ccgctgcaactccatccgtgtggac

SEQ ID NO: 110160 - DNA, 25 bp, mus musculus
cgctgcaactccatccgtgtggaca

SEQ ID NO: 110161 - DNA, 25 bp, mus musculus
gctgcaactccatccgtgtggacag

SEQ ID NO: 110162 - DNA, 25 bp, mus musculus
tgcaactccatccgtgtggacagtg

SEQ ID NO: 110163 - DNA, 25 bp, mus musculus
atgggtttcacgactccatcgctcc

SEQ ID NO: 110164 - DNA, 25 bp, mus musculus
ttgatcaatgccgagtatgcgtgtt

SEQ ID NO: 110165 - DNA, 25 bp, mus musculus
aatgccgagtatgcgtgttacaaag

SEQ ID NO: 110166 - DNA, 25 bp, mus musculus
ttcttcgagtctttcaagagggtca

SEQ ID NO: 110167 - DNA, 25 bp, mus musculus
ttcgagtctttcaagagggtcatcc

SEQ ID NO: 110168 - DNA, 25 bp, mus musculus
atccggagccggagtcagtccatgg

SEQ ID NO: 110169 - DNA, 25 bp, mus musculus
tccatggatgccatgggactgagca

SEQ ID NO: 110170 - DNA, 25 bp, mus musculus
ctgagcaacaagaaacccaacaccg

SEQ ID NO: 110171 - DNA, 25 bp, mus musculus
aacaccgtgtcaactagccacagtg

SEQ ID NO: 110172 - DNA, 25 bp, mus musculus
accgtgtcaactagccacagtggga

SEQ ID NO: 110173 - DNA, 25 bp, mus musculus
gtgtcaactagccacagtgggagct

SEQ ID NO: 110174 - DNA, 25 bp, mus musculus
tcaactagccacagtgggagcttca

SEQ ID NO: 110175 - DNA, 25 bp, mus musculus
actagccacagtgggagcttcaccc

SEQ ID NO: 110176 - DNA, 25 bp, mus musculus
gagacgctctacgaggagctccata

SEQ ID NO: 110177 - DNA, 25 bp, mus musculus
acgctctacgaggagctccatattc

SEQ ID NO: 110178 - DNA, 25 bp, mus musculus
ctctacgaggagctccatattcaca

SEQ ID NO: 110179 - DNA, 25 bp, mus musculus
gaggagctccatattcacagccagt

SEQ ID NO: 110180 - DNA, 25 bp, mus musculus
gagctccatattcacagccagtcca

SEQ ID NO: 110181 - DNA, 25 bp, mus musculus
ctccatattcacagccagtccatga

SEQ ID NO: 110182 - DNA, 25 bp, mus musculus
attcacagccagtccatgatgggcc

SEQ ID NO: 110183 - DNA, 25 bp, mus musculus
ggtggcttcttcgagtctttcaaga

SEQ ID NO: 110184 - DNA, 25 bp, mus musculus
cactgctttaactggcactctgtca

SEQ ID NO: 110185 - DNA, 25 bp, mus musculus
aactggcactctgtcacgtacgagc

SEQ ID NO: 110186 - DNA, 25 bp, mus musculus
tgtcttagtcactactgaacagctc

SEQ ID NO: 110187 - DNA, 25 bp, mus musculus
cactactgaacagctcgcttcccaa

SEQ ID NO: 110188 - DNA, 25 bp, mus musculus
tactgaacagctcgcttcccaatga

SEQ ID NO: 110189 - DNA, 25 bp, mus musculus
tgaacagctcgcttcccaatgagtg

SEQ ID NO: 110190 - DNA, 25 bp, mus musculus
gctcgcttcccaatgagtgagcaca

SEQ ID NO: 110191 - DNA, 25 bp, mus musculus
cgcttcccaatgagtgagcacagtc

SEQ ID NO: 110192 - DNA, 25 bp, mus musculus
ttcccaatgagtgagcacagtccac

SEQ ID NO: 110193 - DNA, 25 bp, mus musculus
agtgagcacagtccactggaatatg

SEQ ID NO: 110194 - DNA, 25 bp, mus musculus
tatgaaccaaccagagactgaaagg

SEQ ID NO: 110195 - DNA, 25 bp, mus musculus
gaaccaaccagagactgaaagggcg

SEQ ID NO: 110196 - DNA, 25 bp, mus musculus
cactctgtcacgtacgagcatgcct

SEQ ID NO: 110197 - DNA, 25 bp, mus musculus
aagatacctgcttactaagaagcca

SEQ ID NO: 110198 - DNA, 25 bp, mus musculus
gtcacgtacgagcatgccttgcggt

SEQ ID NO: 110199 - DNA, 25 bp, mus musculus
tacgagcatgccttgcggtacttgt

SEQ ID NO: 110200 - DNA, 25 bp, mus musculus
tatgtgctggccaatctctgtgagg

SEQ ID NO: 110201 - DNA, 25 bp, mus musculus
ctggccaatctctgtgaggcaccat

SEQ ID NO: 110202 - DNA, 25 bp, mus musculus
gccaatctctgtgaggcaccatatc

SEQ ID NO: 110203 - DNA, 25 bp, mus musculus
tgtgaggcaccatatccgattgaca

SEQ ID NO: 110204 - DNA, 25 bp, mus musculus
gaggcaccatatccgattgacagga

SEQ ID NO: 110205 - DNA, 25 bp, mus musculus
cccttggtctctttatgctgctgag

SEQ ID NO: 110206 - DNA, 25 bp, mus musculus
ttggtctctttatgctgctgagtcc

SEQ ID NO: 110207 - DNA, 25 bp, mus musculus
gccttctggttacagactatttcca

SEQ ID NO: 110208 - DNA, 25 bp, mus musculus
ttacagactatttccatgctagaaa

SEQ ID NO: 110209 - DNA, 25 bp, mus musculus
cagactatttccatgctagaaaata

SEQ ID NO: 110210 - DNA, 25 bp, mus musculus
gagaaaatccaacccattggcaaga

SEQ ID NO: 110211 - DNA, 25 bp, mus musculus
ggagcctcaaatccacctttggagc

SEQ ID NO: 110212 - DNA, 25 bp, mus musculus
gcattaggaacccttctctcctctg

SEQ ID NO: 110213 - DNA, 25 bp, mus musculus
agggagcactgcctcacaaactgtg

SEQ ID NO: 110214 - DNA, 25 bp, mus musculus
gagcactgcctcacaaactgtgaga

SEQ ID NO: 110215 - DNA, 25 bp, mus musculus
tgcctcacaaactgtgagactgcgt

SEQ ID NO: 110216 - DNA, 25 bp, mus musculus
tttatacttggaagtggtgaattat

SEQ ID NO: 110217 - DNA, 25 bp, mus musculus
caataatctttcaggccatgaatct

SEQ ID NO: 110218 - DNA, 25 bp, mus musculus
taatctttcaggccatgaatctggg

SEQ ID NO: 110219 - DNA, 25 bp, mus musculus
tctttcaggccatgaatctgggagg

SEQ ID NO: 110220 - DNA, 25 bp, mus musculus
ctgtaagctccatcagccctgtcct

SEQ ID NO: 110221 - DNA, 25 bp, mus musculus
ccatcagccctgtcctgagacagca

SEQ ID NO: 110222 - DNA, 25 bp, mus musculus
cactggagactttcttgtggggctt

SEQ ID NO: 110223 - DNA, 25 bp, mus musculus
tacttagccttctggttacagacta

SEQ ID NO: 110224 - DNA, 25 bp, mus musculus
ttagccttctggttacagactattt

SEQ ID NO: 110225 - DNA, 25 bp, mus musculus
acacgtgctcttcgacatcaccggc

SEQ ID NO: 110226 - DNA, 25 bp, mus musculus
caccggcgatgacgagccctctggg

SEQ ID NO: 110227 - DNA, 25 bp, mus musculus
acgccacgatctcggctatacgggt

SEQ ID NO: 110228 - DNA, 25 bp, mus musculus
tacgggttcctcccttcacagcatc

SEQ ID NO: 110229 - DNA, 25 bp, mus musculus
cagcatcattccaggattcacgtcg

SEQ ID NO: 110230 - DNA, 25 bp, mus musculus
catcattccaggattcacgtcgcca

SEQ ID NO: 110231 - DNA, 25 bp, mus musculus
cattccaggattcacgtcgccagcc

SEQ ID NO: 110232 - DNA, 25 bp, mus musculus
ggtccatctacggacagaaatcttg

SEQ ID NO: 110233 - DNA, 25 bp, mus musculus
gatgacgaactctcatcctcaacgc

SEQ ID NO: 110234 - DNA, 25 bp, mus musculus
gacgaactctcatcctcaacgcata

SEQ ID NO: 110235 - DNA, 25 bp, mus musculus
tcctcaacgcatacaggtcctgcga

SEQ ID NO: 110236 - DNA, 25 bp, mus musculus
tcaacgcatacaggtcctgcgatct

SEQ ID NO: 110237 - DNA, 25 bp, mus musculus
tcccagacacacttccaaagacagc

SEQ ID NO: 110238 - DNA, 25 bp, mus musculus
cagaacactttcgcgctccgagcac

SEQ ID NO: 110239 - DNA, 25 bp, mus musculus
aacactttcgcgctccgagcactgc

SEQ ID NO: 110240 - DNA, 25 bp, mus musculus
ttcgcgctccgagcactgcagacgc

SEQ ID NO: 110241 - DNA, 25 bp, mus musculus
ctccgagcactgcagacgccacgat

SEQ ID NO: 110242 - DNA, 25 bp, mus musculus
cgagcactgcagacgccacgatctc

SEQ ID NO: 110243 - DNA, 25 bp, mus musculus
ctgcagacgccacgatctcggctat

SEQ ID NO: 110244 - DNA, 25 bp, mus musculus
cagacgccacgatctcggctatacg

SEQ ID NO: 110245 - DNA, 25 bp, mus musculus
tcctcgaccgagcgctggtacagct

SEQ ID NO: 110246 - DNA, 25 bp, mus musculus
tcgaccgagcgctggtacagcttcc

SEQ ID NO: 110247 - DNA, 25 bp, mus musculus
cccggcgaagcagtcatgagctgct

SEQ ID NO: 110248 - DNA, 25 bp, mus musculus
gtcatgagctgctgacggccacgtc

SEQ ID NO: 110249 - DNA, 25 bp, mus musculus
atgagctgctgacggccacgtcatc

SEQ ID NO: 110250 - DNA, 25 bp, mus musculus
tgacggccacgtcatcactacttgg

SEQ ID NO: 110251 - DNA, 25 bp, mus musculus
cggccacgtcatcactacttggaac

SEQ ID NO: 110252 - DNA, 25 bp, mus musculus
ccacgtcatcactacttggaacgag

SEQ ID NO: 110253 - DNA, 25 bp, mus musculus
ccgatgcgctgaggtcctttcccag

SEQ ID NO: 110254 - DNA, 25 bp, mus musculus
ttcccagcttacttctcgcgtatgg

SEQ ID NO: 110255 - DNA, 25 bp, mus musculus
gcttacttctcgcgtatggaatcat

SEQ ID NO: 110256 - DNA, 25 bp, mus musculus
tacttctcgcgtatggaatcatgtc

SEQ ID NO: 110257 - DNA, 25 bp, mus musculus
accgagcgctggtacagcttccacc

SEQ ID NO: 110258 - DNA, 25 bp, mus musculus
agcgaagcctgtgtactgctcatct

SEQ ID NO: 110259 - DNA, 25 bp, mus musculus
gcctgtgtactgctcatctacactc

SEQ ID NO: 110260 - DNA, 25 bp, mus musculus
tgtgtactgctcatctacactctca

SEQ ID NO: 110261 - DNA, 25 bp, mus musculus
gtactgctcatctacactctcagca

SEQ ID NO: 110262 - DNA, 25 bp, mus musculus
ctcatctacactctcagcaggagat

SEQ ID NO: 110263 - DNA, 25 bp, mus musculus
atctacactctcagcaggagatggc

SEQ ID NO: 110264 - DNA, 25 bp, mus musculus
tacactctcagcaggagatggccac

SEQ ID NO: 110265 - DNA, 25 bp, mus musculus
gagttctccttcaagaagctaacat

SEQ ID NO: 110266 - DNA, 25 bp, mus musculus
ctaacatgtgtgcagacccgcctga

SEQ ID NO: 110267 - DNA, 25 bp, mus musculus
acctttctgactgatatcccctttg

SEQ ID NO: 110268 - DNA, 25 bp, mus musculus
ctgactgatatcccctttgaatgca

SEQ ID NO: 110269 - DNA, 25 bp, mus musculus
agcccaggccagctctgaatccagc

SEQ ID NO: 110270 - DNA, 25 bp, mus musculus
ggccagctctgaatccagcttctca

SEQ ID NO: 110271 - DNA, 25 bp, mus musculus
atccagcttctcagactgctgcttt

SEQ ID NO: 110272 - DNA, 25 bp, mus musculus
agactgctgcttttgtgcctgcgta

SEQ ID NO: 110273 - DNA, 25 bp, mus musculus
ctgcttttgtgcctgcgtaatgagc

SEQ ID NO: 110274 - DNA, 25 bp, mus musculus
cctctgaaaacgctgactcagcttg

SEQ ID NO: 110275 - DNA, 25 bp, mus musculus
tattttctactgatagggaccatta

SEQ ID NO: 110276 - DNA, 25 bp, mus musculus
ttgcaactctatttattgagaatgt

SEQ ID NO: 110277 - DNA, 25 bp, mus musculus
cagacccgcctgaagatattcgagc

SEQ ID NO: 110278 - DNA, 25 bp, mus musculus
ttcgagcagggtctacggggcaatt

SEQ ID NO: 110279 - DNA, 25 bp, mus musculus
ttcaccaaactcaagggcgccttga

SEQ ID NO: 110280 - DNA, 25 bp, mus musculus
aaactcaagggcgccttgaacatga

SEQ ID NO: 110281 - DNA, 25 bp, mus musculus
gccttgaacatgacagccagctact

SEQ ID NO: 110282 - DNA, 25 bp, mus musculus
acagccagctactaccagacatact

SEQ ID NO: 110283 - DNA, 25 bp, mus musculus
gttaccacctatgcggatttcatag

SEQ ID NO: 110284 - DNA, 25 bp, mus musculus
acctatgcggatttcatagacagcc

SEQ ID NO: 110285 - DNA, 25 bp, mus musculus
aattcacttcagagcaatccactac

SEQ ID NO: 110286 - DNA, 25 bp, mus musculus
cttcagagcaatccactactgccag

SEQ ID NO: 110287 - DNA, 25 bp, mus musculus
ctcatcccaggtggatcccatgtgt

SEQ ID NO: 110288 - DNA, 25 bp, mus musculus
atcccaggtggatcccatgtgtctg

SEQ ID NO: 110289 - DNA, 25 bp, mus musculus
tcccatgtgtctgcagtagaccagt

SEQ ID NO: 110290 - DNA, 25 bp, mus musculus
catgtgtctgcagtagaccagtcac

SEQ ID NO: 110291 - DNA, 25 bp, mus musculus
gtagaccagtcacctttgtagccag

SEQ ID NO: 110292 - DNA, 25 bp, mus musculus
cagtcacctttgtagccagcaccat

SEQ ID NO: 110293 - DNA, 25 bp, mus musculus
tcacctttgtagccagcaccatgcc

SEQ ID NO: 110294 - DNA, 25 bp, mus musculus
tttagtcttgagtacccttcctgca

SEQ ID NO: 110295 - DNA, 25 bp, mus musculus
agtcttgagtacccttcctgcattt

SEQ ID NO: 110296 - DNA, 25 bp, mus musculus
gagtacccttcctgcatttattggt

SEQ ID NO: 110297 - DNA, 25 bp, mus musculus
ccactactgccagaccagaaggtct

SEQ ID NO: 110298 - DNA, 25 bp, mus musculus
ctactgccagaccagaaggtctgct

SEQ ID NO: 110299 - DNA, 25 bp, mus musculus
atgcagaatcgtgccttcatctcag

SEQ ID NO: 110300 - DNA, 25 bp, mus musculus
aatcgtgccttcatctcagaattgc

SEQ ID NO: 110301 - DNA, 25 bp, mus musculus
cgtgccttcatctcagaattgctca

SEQ ID NO: 110302 - DNA, 25 bp, mus musculus
atctcagaattgctcatcccaggtg

SEQ ID NO: 110303 - DNA, 25 bp, mus musculus
tcagaattgctcatcccaggtggat

SEQ ID NO: 110304 - DNA, 25 bp, mus musculus
gaattgctcatcccaggtggatccc

SEQ ID NO: 110305 - DNA, 25 bp, mus musculus
cgccctgcagctccacatgcaaagg

SEQ ID NO: 110306 - DNA, 25 bp, mus musculus
gcagctccacatgcaaaggactcca

SEQ ID NO: 110307 - DNA, 25 bp, mus musculus
cttgcagtcctgtggcagggagcac

SEQ ID NO: 110308 - DNA, 25 bp, mus musculus
gtcctgtggcagggagcacagactg

SEQ ID NO: 110309 - DNA, 25 bp, mus musculus
tcagcccacagtggcttttcatttt

SEQ ID NO: 110310 - DNA, 25 bp, mus musculus
tataagacatgaactcctctgggca

SEQ ID NO: 110311 - DNA, 25 bp, mus musculus
acatgaactcctctgggcaggtggc

SEQ ID NO: 110312 - DNA, 25 bp, mus musculus
ccacaagccttctctgatggattag

SEQ ID NO: 110313 - DNA, 25 bp, mus musculus
gccttctctgatggattagaggtgc

SEQ ID NO: 110314 - DNA, 25 bp, mus musculus
ccactctgtgtcttcttcctcatgt

SEQ ID NO: 110315 - DNA, 25 bp, mus musculus
ttcttcctcatgtgcccttcagtct

SEQ ID NO: 110316 - DNA, 25 bp, mus musculus
ctcatgtgcccttcagtctgctcct

SEQ ID NO: 110317 - DNA, 25 bp, mus musculus
actccaggctgcaggcttctcttga

SEQ ID NO: 110318 - DNA, 25 bp, mus musculus
ctcttgactccaagaacctggaaca

SEQ ID NO: 110319 - DNA, 25 bp, mus musculus
actccaagaacctggaacaagtgtg

SEQ ID NO: 110320 - DNA, 25 bp, mus musculus
ggcacttagcctgaggacctctgca

SEQ ID NO: 110321 - DNA, 25 bp, mus musculus
tagcctgaggacctctgcatgtcct

SEQ ID NO: 110322 - DNA, 25 bp, mus musculus
atgtcctgcctggttcctggaccac

SEQ ID NO: 110323 - DNA, 25 bp, mus musculus
gttcctggaccactggccagccagc

SEQ ID NO: 110324 - DNA, 25 bp, mus musculus
ctggccagccagcagggaacatgtt

SEQ ID NO: 110325 - DNA, 25 bp, mus musculus
tgaggcccctcaagttgcccagacc

SEQ ID NO: 110326 - DNA, 25 bp, mus musculus
tgaagccagggcatgtttgcagtgt

SEQ ID NO: 110327 - DNA, 25 bp, mus musculus
caatcggtccaggagtcttcactaa

SEQ ID NO: 110328 - DNA, 25 bp, mus musculus
gtccaggagtcttcactaaggttgt

SEQ ID NO: 110329 - DNA, 25 bp, mus musculus
gagtcttcactaaggttgtgcacta

SEQ ID NO: 110330 - DNA, 25 bp, mus musculus
aggttgtgcactacctgccgtggat

SEQ ID NO: 110331 - DNA, 25 bp, mus musculus
tgcactacctgccgtggataagcag

SEQ ID NO: 110332 - DNA, 25 bp, mus musculus
tgaagctgctctaacaggagttaaa

SEQ ID NO: 110333 - DNA, 25 bp, mus musculus
tgaccagcctgtccgacctcaggca

SEQ ID NO: 110334 - DNA, 25 bp, mus musculus
gcctgtccgacctcaggcaagaacc

SEQ ID NO: 110335 - DNA, 25 bp, mus musculus
ccgacctcaggcaagaaccatgtgg

SEQ ID NO: 110336 - DNA, 25 bp, mus musculus
taaataacctccagagtgcatagag

SEQ ID NO: 110337 - DNA, 25 bp, mus musculus
catccatcaatgcaacacaaagatc

SEQ ID NO: 110338 - DNA, 25 bp, mus musculus
cctccagagtgcatagagctgaaaa

SEQ ID NO: 110339 - DNA, 25 bp, mus musculus
caacacaaagatcttcctgcctacg

SEQ ID NO: 110340 - DNA, 25 bp, mus musculus
gcctacgagaggctcaactgatcat

SEQ ID NO: 110341 - DNA, 25 bp, mus musculus
agtatttcaagaccatgcagatttg

SEQ ID NO: 110342 - DNA, 25 bp, mus musculus
tcaagaccatgcagatttgtgctgg

SEQ ID NO: 110343 - DNA, 25 bp, mus musculus
ccatgcagatttgtgctggagaccc

SEQ ID NO: 110344 - DNA, 25 bp, mus musculus
agtctacttacagtggtgactccgg

SEQ ID NO: 110345 - DNA, 25 bp, mus musculus
acaggacaatcggtccaggagtctt

SEQ ID NO: 110346 - DNA, 25 bp, mus musculus
cgagtgcctcgcagcttgagcccac

SEQ ID NO: 110347 - DNA, 25 bp, mus musculus
agtgcctcgcagcttgagcccactg

SEQ ID NO: 110348 - DNA, 25 bp, mus musculus
gcagctgcgcgacgtcatggacaac

SEQ ID NO: 110349 - DNA, 25 bp, mus musculus
cagctgcgcgacgtcatggacaact

SEQ ID NO: 110350 - DNA, 25 bp, mus musculus
ctgcgcgacgtcatggacaactccg

SEQ ID NO: 110351 - DNA, 25 bp, mus musculus
cgacgtcatggacaactccgggaag

SEQ ID NO: 110352 - DNA, 25 bp, mus musculus
gacgtcatggacaactccgggaagc

SEQ ID NO: 110353 - DNA, 25 bp, mus musculus
cgtcatggacaactccgggaagcag

SEQ ID NO: 110354 - DNA, 25 bp, mus musculus
gtcatggacaactccgggaagcagg

SEQ ID NO: 110355 - DNA, 25 bp, mus musculus
catggacaactccgggaagcaggct

SEQ ID NO: 110356 - DNA, 25 bp, mus musculus
atggacaactccgggaagcaggctg

SEQ ID NO: 110357 - DNA, 25 bp, mus musculus
gtgaagaactcgcagtccttcttct

SEQ ID NO: 110358 - DNA, 25 bp, mus musculus
gcctcgcagcttgagcccactggtt

SEQ ID NO: 110359 - DNA, 25 bp, mus musculus
cttgagcccactggttggttcgcag

SEQ ID NO: 110360 - DNA, 25 bp, mus musculus
ttgagcccactggttggttcgcagg

SEQ ID NO: 110361 - DNA, 25 bp, mus musculus
aggcctgggtgacgtcaacgcagcg

SEQ ID NO: 110362 - DNA, 25 bp, mus musculus
gtccggggcctgtgagtcgtcgcca

SEQ ID NO: 110363 - DNA, 25 bp, mus musculus
cgtcgccaggctgtgtcgggcctga

SEQ ID NO: 110364 - DNA, 25 bp, mus musculus
gcctgagccgagcagctgcgcgacg

SEQ ID NO: 110365 - DNA, 25 bp, mus musculus
gagcagctgcgcgacgtcatggaca

SEQ ID NO: 110366 - DNA, 25 bp, mus musculus
cacagttgaatctcagcaagtgata

SEQ ID NO: 110367 - DNA, 25 bp, mus musculus
agttgaatctcagcaagtgatatgg

SEQ ID NO: 110368 - DNA, 25 bp, mus musculus
tactctatcccgagataactttgag

SEQ ID NO: 110369 - DNA, 25 bp, mus musculus
actctatcccgagataactttgagg

SEQ ID NO: 110370 - DNA, 25 bp, mus musculus
ctctatcccgagataactttgaggc

SEQ ID NO: 110371 - DNA, 25 bp, mus musculus
ctatcccgagataactttgaggcat

SEQ ID NO: 110372 - DNA, 25 bp, mus musculus
atcccgagataactttgaggcataa

SEQ ID NO: 110373 - DNA, 25 bp, mus musculus
ttttcttcagtgctaagatcatgat

SEQ ID NO: 110374 - DNA, 25 bp, mus musculus
tgtgaaatcaaacctcgttttatgt

SEQ ID NO: 110375 - DNA, 25 bp, mus musculus
gcaatttagcttcctactgtgtgtt

SEQ ID NO: 110376 - DNA, 25 bp, mus musculus
caatttagcttcctactgtgtgttt

SEQ ID NO: 110377 - DNA, 25 bp, mus musculus
accttgtaacaatatcactataata

SEQ ID NO: 110378 - DNA, 25 bp, mus musculus
ttgaatctcagcaagtgatatggat

SEQ ID NO: 110379 - DNA, 25 bp, mus musculus
aatctcagcaagtgatatggattta

SEQ ID NO: 110380 - DNA, 25 bp, mus musculus
tagaattgtctgccttccaccctga

SEQ ID NO: 110381 - DNA, 25 bp, mus musculus
tgccttccaccctgaaaagaaggcg

SEQ ID NO: 110382 - DNA, 25 bp, mus musculus
cttccaccctgaaaagaaggcgcag

SEQ ID NO: 110383 - DNA, 25 bp, mus musculus
ttccaccctgaaaagaaggcgcaga

SEQ ID NO: 110384 - DNA, 25 bp, mus musculus
tatgtatttactctatcccgagata

SEQ ID NO: 110385 - DNA, 25 bp, mus musculus
atgtatttactctatcccgagataa

SEQ ID NO: 110386 - DNA, 25 bp, mus musculus
aatgactgtctacatcagccggaca

SEQ ID NO: 110387 - DNA, 25 bp, mus musculus
tgactgtctacatcagccggacaca

SEQ ID NO: 110388 - DNA, 25 bp, mus musculus
gaacagcagctgtccatcacaggcc

SEQ ID NO: 110389 - DNA, 25 bp, mus musculus
agcagctgtccatcacaggccctct

SEQ ID NO: 110390 - DNA, 25 bp, mus musculus
cagctgtccatcacaggccctctgg

SEQ ID NO: 110391 - DNA, 25 bp, mus musculus
tgtccatcacaggccctctgggcgg

SEQ ID NO: 110392 - DNA, 25 bp, mus musculus
gtccagtacccaaccttcgcacgag

SEQ ID NO: 110393 - DNA, 25 bp, mus musculus
tacccaaccttcgcacgagtgtgtt

SEQ ID NO: 110394 - DNA, 25 bp, mus musculus
caaccttcgcacgagtgtgttgcac

SEQ ID NO: 110395 - DNA, 25 bp, mus musculus
accttcgcacgagtgtgttgcacgt

SEQ ID NO: 110396 - DNA, 25 bp, mus musculus
tcgcacgagtgtgttgcacgtttac

SEQ ID NO: 110397 - DNA, 25 bp, mus musculus
gtgtgttgcacgtttacatggggtg

SEQ ID NO: 110398 - DNA, 25 bp, mus musculus
tgtctacatcagccggacacagccc

SEQ ID NO: 110399 - DNA, 25 bp, mus musculus
tctacatcagccggacacagccctg

SEQ ID NO: 110400 - DNA, 25 bp, mus musculus
acagccctggagcgctggcatactc

SEQ ID NO: 110401 - DNA, 25 bp, mus musculus
agccctggagcgctggcatactctg

SEQ ID NO: 110402 - DNA, 25 bp, mus musculus
cgctggcatactctgaccagagagc

SEQ ID NO: 110403 - DNA, 25 bp, mus musculus
catactctgaccagagagctgcccc

SEQ ID NO: 110404 - DNA, 25 bp, mus musculus
tgcagcaggggcttaccctttggct

SEQ ID NO: 110405 - DNA, 25 bp, mus musculus
cctttggcttgagtgaacagcagct

SEQ ID NO: 110406 - DNA, 25 bp, mus musculus
ttccagcacaatgactgcttccctt

SEQ ID NO: 110407 - DNA, 25 bp, mus musculus
tttttcctgaatacagcagacactg

SEQ ID NO: 110408 - DNA, 25 bp, mus musculus
ttcctctggaacaacaaggtgataa

SEQ ID NO: 110409 - DNA, 25 bp, mus musculus
gtgataaatctcttccggcccacta

SEQ ID NO: 110410 - DNA, 25 bp, mus musculus
ttccggcccactatgggagcttcac

SEQ ID NO: 110411 - DNA, 25 bp, mus musculus
gcttcacaaatcacactgcaacgcg

SEQ ID NO: 110412 - DNA, 25 bp, mus musculus
acactgcaacgcgctaaagacggga

SEQ ID NO: 110413 - DNA, 25 bp, mus musculus
ttcaacttctgtaccagcaacactg

SEQ ID NO: 110414 - DNA, 25 bp, mus musculus
accagcaacactgtgcatgaagatg

SEQ ID NO: 110415 - DNA, 25 bp, mus musculus
gttctgcagtctctgtacccttgtt

SEQ ID NO: 110416 - DNA, 25 bp, mus musculus
cagtctctgtacccttgttaatggt

SEQ ID NO: 110417 - DNA, 25 bp, mus musculus
tgtgcccgtgcctcttcccataata

SEQ ID NO: 110418 - DNA, 25 bp, mus musculus
ctgaatacagcagacactggtaact

SEQ ID NO: 110419 - DNA, 25 bp, mus musculus
ataataaacgttcctgatccacttg

SEQ ID NO: 110420 - DNA, 25 bp, mus musculus
aaagtatcagtcacactatcaggac

SEQ ID NO: 110421 - DNA, 25 bp, mus musculus
tcagtcacactatcaggaccaaaga

SEQ ID NO: 110422 - DNA, 25 bp, mus musculus
acactatcaggaccaaagaagctga

SEQ ID NO: 110423 - DNA, 25 bp, mus musculus
tacatcttggtcgctctgtacggat

SEQ ID NO: 110424 - DNA, 25 bp, mus musculus
ttggtcgctctgtacggatgtaacg

SEQ ID NO: 110425 - DNA, 25 bp, mus musculus
ttcaaaggatccctccaaccagaag

SEQ ID NO: 110426 - DNA, 25 bp, mus musculus
tatattcgtgacattgatgtggacg

SEQ ID NO: 110427 - DNA, 25 bp, mus musculus
tcaagctgaaccagccacccgagga

SEQ ID NO: 110428 - DNA, 25 bp, mus musculus
accagccacccgaggatggcatctc

SEQ ID NO: 110429 - DNA, 25 bp, mus musculus
ccaattccatgaggctcaagtacca

SEQ ID NO: 110430 - DNA, 25 bp, mus musculus
ggctcaagtaccagcacactggtgc

SEQ ID NO: 110431 - DNA, 25 bp, mus musculus
acactggtgctgtcctggactgcgc

SEQ ID NO: 110432 - DNA, 25 bp, mus musculus
ctggtgctgtcctggactgcgcctt

SEQ ID NO: 110433 - DNA, 25 bp, mus musculus
tcctggactgcgccttctacgatcc

SEQ ID NO: 110434 - DNA, 25 bp, mus musculus
tggactgcgccttctacgatccaac

SEQ ID NO: 110435 - DNA, 25 bp, mus musculus
gcgccttctacgatccaacgcatgc

SEQ ID NO: 110436 - DNA, 25 bp, mus musculus
tctacgatccaacgcatgcctggag

SEQ ID NO: 110437 - DNA, 25 bp, mus musculus
atccaacgcatgcctggagtggtgg

SEQ ID NO: 110438 - DNA, 25 bp, mus musculus
caacgcatgcctggagtggtggatt

SEQ ID NO: 110439 - DNA, 25 bp, mus musculus
agccacccgaggatggcatctcctc

SEQ ID NO: 110440 - DNA, 25 bp, mus musculus
aggatggcatctcctcggttaagtt

SEQ ID NO: 110441 - DNA, 25 bp, mus musculus
atggcatctcctcggttaagttcag

SEQ ID NO: 110442 - DNA, 25 bp, mus musculus
gcatctcctcggttaagttcagccc

SEQ ID NO: 110443 - DNA, 25 bp, mus musculus
ttaagttcagccccaacacatccca

SEQ ID NO: 110444 - DNA, 25 bp, mus musculus
tgcgcctctacgatgtgcccgccaa

SEQ ID NO: 110445 - DNA, 25 bp, mus musculus
acgatgtgcccgccaattccatgag

SEQ ID NO: 110446 - DNA, 25 bp, mus musculus
tgcccgccaattccatgaggctcaa

SEQ ID NO: 110447 - DNA, 25 bp, mus musculus
gtgctctgtgcctgggtatgatgcc

SEQ ID NO: 110448 - DNA, 25 bp, mus musculus
ctctgtgcctgggtatgatgccagc

SEQ ID NO: 110449 - DNA, 25 bp, mus musculus
gatcacgtctattgccatcggtcag

SEQ ID NO: 110450 - DNA, 25 bp, mus musculus
cacgtctattgccatcggtcagcag

SEQ ID NO: 110451 - DNA, 25 bp, mus musculus
tattgccatcggtcagcagaaggct

SEQ ID NO: 110452 - DNA, 25 bp, mus musculus
tgccatcggtcagcagaaggcttta

SEQ ID NO: 110453 - DNA, 25 bp, mus musculus
ggctttaaccaagcagataaggcca

SEQ ID NO: 110454 - DNA, 25 bp, mus musculus
gataaggccatcaacaccgccgtga

SEQ ID NO: 110455 - DNA, 25 bp, mus musculus
aaggccatcaacaccgccgtgaagt

SEQ ID NO: 110456 - DNA, 25 bp, mus musculus
atcaacaccgccgtgaagtcaggca

SEQ ID NO: 110457 - DNA, 25 bp, mus musculus
tgcttccgacttttcctcaccatgg

SEQ ID NO: 110458 - DNA, 25 bp, mus musculus
ttccgacttttcctcaccatggaga

SEQ ID NO: 110459 - DNA, 25 bp, mus musculus
tgatgccagcggacatgttgaggac

SEQ ID NO: 110460 - DNA, 25 bp, mus musculus
cgacttttcctcaccatggagatca

SEQ ID NO: 110461 - DNA, 25 bp, mus musculus
tgccagcggacatgttgaggacctc

SEQ ID NO: 110462 - DNA, 25 bp, mus musculus
acatgttgaggacctcgcagcagag

SEQ ID NO: 110463 - DNA, 25 bp, mus musculus
tgttgaggacctcgcagcagagcag

SEQ ID NO: 110464 - DNA, 25 bp, mus musculus
ggacctcgcagcagagcagaacacg

SEQ ID NO: 110465 - DNA, 25 bp, mus musculus
gcagaacacgcagatcacgtctatt

SEQ ID NO: 110466 - DNA, 25 bp, mus musculus
cacgcagatcacgtctattgccatc

SEQ ID NO: 110467 - DNA, 25 bp, mus musculus
gcagatcacgtctattgccatcggt

SEQ ID NO: 110468 - DNA, 25 bp, mus musculus
atcagcaccaaggagctgggcaagg

SEQ ID NO: 110469 - DNA, 25 bp, mus musculus
cttccgcatgtttgacaaaaacgct

SEQ ID NO: 110470 - DNA, 25 bp, mus musculus
tgcagctgggctctctagactctga

SEQ ID NO: 110471 - DNA, 25 bp, mus musculus
cagctgggctctctagactctgagc

SEQ ID NO: 110472 - DNA, 25 bp, mus musculus
ctctagactctgagcctgcctgtgt

SEQ ID NO: 110473 - DNA, 25 bp, mus musculus
actctgagcctgcctgtgtccttga

SEQ ID NO: 110474 - DNA, 25 bp, mus musculus
tctgagcctgcctgtgtccttgaac

SEQ ID NO: 110475 - DNA, 25 bp, mus musculus
tgagcctgcctgtgtccttgaacct

SEQ ID NO: 110476 - DNA, 25 bp, mus musculus
cctgcctgtgtccttgaaccttggc

SEQ ID NO: 110477 - DNA, 25 bp, mus musculus
tgcctgtgtccttgaaccttggcct

SEQ ID NO: 110478 - DNA, 25 bp, mus musculus
tgtgtccttgaaccttggccttccg

SEQ ID NO: 110479 - DNA, 25 bp, mus musculus
cattcctgtcctggggaacgcaaat

SEQ ID NO: 110480 - DNA, 25 bp, mus musculus
tgatgctgcaggccacaggtgagac

SEQ ID NO: 110481 - DNA, 25 bp, mus musculus
atgctgcaggccacaggtgagacca

SEQ ID NO: 110482 - DNA, 25 bp, mus musculus
actatgacgagttcctggaattcat

SEQ ID NO: 110483 - DNA, 25 bp, mus musculus
tgacgagttcctggaattcatgaag

SEQ ID NO: 110484 - DNA, 25 bp, mus musculus
acgagttcctggaattcatgaaggg

SEQ ID NO: 110485 - DNA, 25 bp, mus musculus
tgctggtcttgcacggttgcctgcg

SEQ ID NO: 110486 - DNA, 25 bp, mus musculus
cccagaccccgtggtaggagtgcag

SEQ ID NO: 110487 - DNA, 25 bp, mus musculus
agtgcagctgggctctctagactct

SEQ ID NO: 110488 - DNA, 25 bp, mus musculus
ttcaatcaattcattcaaacctggc

SEQ ID NO: 110489 - DNA, 25 bp, mus musculus
caatcaattcattcaaacctggctg

SEQ ID NO: 110490 - DNA, 25 bp, mus musculus
atgctggagtctctctagtcttttc

SEQ ID NO: 110491 - DNA, 25 bp, mus musculus
tgctggagtctctctagtcttttcg

SEQ ID NO: 110492 - DNA, 25 bp, mus musculus
ctggagtctctctagtcttttcgct

SEQ ID NO: 110493 - DNA, 25 bp, mus musculus
tggagtctctctagtcttttcgctc

SEQ ID NO: 110494 - DNA, 25 bp, mus musculus
gagtctctctagtcttttcgctcca

SEQ ID NO: 110495 - DNA, 25 bp, mus musculus
agtctctctagtcttttcgctccat

SEQ ID NO: 110496 - DNA, 25 bp, mus musculus
tctctctagtcttttcgctccatgg

SEQ ID NO: 110497 - DNA, 25 bp, mus musculus
tctagtcttttcgctccatggttga

SEQ ID NO: 110498 - DNA, 25 bp, mus musculus
tagtcttttcgctccatggttgatg

SEQ ID NO: 110499 - DNA, 25 bp, mus musculus
agtcttttcgctccatggttgatga

SEQ ID NO: 110500 - DNA, 25 bp, mus musculus
aatcaattcattcaaacctggctgg

SEQ ID NO: 110501 - DNA, 25 bp, mus musculus
ttttcgctccatggttgatgaagcg

SEQ ID NO: 110502 - DNA, 25 bp, mus musculus
tcaattcattcaaacctggctgggt

SEQ ID NO: 110503 - DNA, 25 bp, mus musculus
caattcattcaaacctggctgggta

SEQ ID NO: 110504 - DNA, 25 bp, mus musculus
ttcattcaaacctggctgggtaaat

SEQ ID NO: 110505 - DNA, 25 bp, mus musculus
cattcaaacctggctgggtaaatca

SEQ ID NO: 110506 - DNA, 25 bp, mus musculus
tcaaacctggctgggtaaatcaccg

SEQ ID NO: 110507 - DNA, 25 bp, mus musculus
cacatgctggagtctctctagtctt

SEQ ID NO: 110508 - DNA, 25 bp, mus musculus
acatgctggagtctctctagtcttt

SEQ ID NO: 110509 - DNA, 25 bp, mus musculus
tgagacctcccaggcagtgcactca

SEQ ID NO: 110510 - DNA, 25 bp, mus musculus
agacctcccaggcagtgcactcatc

SEQ ID NO: 110511 - DNA, 25 bp, mus musculus
ccttcctcatggctggtgaccatcc

SEQ ID NO: 110512 - DNA, 25 bp, mus musculus
ttcctcatggctggtgaccatcctc

SEQ ID NO: 110513 - DNA, 25 bp, mus musculus
cctcatggctggtgaccatcctcat

SEQ ID NO: 110514 - DNA, 25 bp, mus musculus
tcatggctggtgaccatcctcatcg

SEQ ID NO: 110515 - DNA, 25 bp, mus musculus
tgtgtgcacactagctccagttgtt

SEQ ID NO: 110516 - DNA, 25 bp, mus musculus
tgtgcacactagctccagttgttgt

SEQ ID NO: 110517 - DNA, 25 bp, mus musculus
tgcacactagctccagttgttgtcc

SEQ ID NO: 110518 - DNA, 25 bp, mus musculus
agttgttgtccaggatgcgcggtat

SEQ ID NO: 110519 - DNA, 25 bp, mus musculus
ttgttgtccaggatgcgcggtatcg

SEQ ID NO: 110520 - DNA, 25 bp, mus musculus
gttgtccaggatgcgcggtatcgac

SEQ ID NO: 110521 - DNA, 25 bp, mus musculus
ctcccaggcagtgcactcatcagca

SEQ ID NO: 110522 - DNA, 25 bp, mus musculus
cccaggcagtgcactcatcagcaag

SEQ ID NO: 110523 - DNA, 25 bp, mus musculus
ggcagtgcactcatcagcaagtacc

SEQ ID NO: 110524 - DNA, 25 bp, mus musculus
cagtgcactcatcagcaagtacctg

SEQ ID NO: 110525 - DNA, 25 bp, mus musculus
gtacctgaccttcctcatggctggt

SEQ ID NO: 110526 - DNA, 25 bp, mus musculus
acctgaccttcctcatggctggtga

SEQ ID NO: 110527 - DNA, 25 bp, mus musculus
ctgaccttcctcatggctggtgacc

SEQ ID NO: 110528 - DNA, 25 bp, mus musculus
gaccttcctcatggctggtgaccat

SEQ ID NO: 110529 - DNA, 25 bp, mus musculus
gccgtgttcatctgcctgctggaac

SEQ ID NO: 110530 - DNA, 25 bp, mus musculus
ttcatctgcctgctggaacccacac

SEQ ID NO: 110531 - DNA, 25 bp, mus musculus
agctctcaactgtgtactttatatg

SEQ ID NO: 110532 - DNA, 25 bp, mus musculus
tttgctttccaggatcaagatgttt

SEQ ID NO: 110533 - DNA, 25 bp, mus musculus
attatctccaaaagtggaacaggag

SEQ ID NO: 110534 - DNA, 25 bp, mus musculus
cttttcgaagtgactcagaaagtct

SEQ ID NO: 110535 - DNA, 25 bp, mus musculus
ctgtggccttttcttggcagctatg

SEQ ID NO: 110536 - DNA, 25 bp, mus musculus
ccttttcttggcagctatggccgca

SEQ ID NO: 110537 - DNA, 25 bp, mus musculus
cttggcagctatggccgcattatga

SEQ ID NO: 110538 - DNA, 25 bp, mus musculus
agctatggccgcattatgacttgta

SEQ ID NO: 110539 - DNA, 25 bp, mus musculus
tcccttacatgtcactcaaacaacg

SEQ ID NO: 110540 - DNA, 25 bp, mus musculus
cactcaaacaacgttaaaatgcaga

SEQ ID NO: 110541 - DNA, 25 bp, mus musculus
tgcctgctggaacccacactttgat

SEQ ID NO: 110542 - DNA, 25 bp, mus musculus
ctggaacccacactttgatagggct

SEQ ID NO: 110543 - DNA, 25 bp, mus musculus
cccacactttgatagggctggacta

SEQ ID NO: 110544 - DNA, 25 bp, mus musculus
tactcaccgtttatattcttgtcgc

SEQ ID NO: 110545 - DNA, 25 bp, mus musculus
ccgtttatattcttgtcgcctcttg

SEQ ID NO: 110546 - DNA, 25 bp, mus musculus
atattcttgtcgcctcttgcccaaa

SEQ ID NO: 110547 - DNA, 25 bp, mus musculus
ttgtcgcctcttgcccaaagctctc

SEQ ID NO: 110548 - DNA, 25 bp, mus musculus
cctcttgcccaaagctctcaactgt

SEQ ID NO: 110549 - DNA, 25 bp, mus musculus
gactgtcttcaccgtgtttatgatt

SEQ ID NO: 110550 - DNA, 25 bp, mus musculus
cttcaccgtgtttatgatttctgtg

SEQ ID NO: 110551 - DNA, 25 bp, mus musculus
catgcttagtcgcttagtcggcaga

SEQ ID NO: 110552 - DNA, 25 bp, mus musculus
tagtcgcttagtcggcagagctcag

SEQ ID NO: 110553 - DNA, 25 bp, mus musculus
cggcagagctcagccaccagcagtt

SEQ ID NO: 110554 - DNA, 25 bp, mus musculus
gccaccagcagttcccaagacaaac

SEQ ID NO: 110555 - DNA, 25 bp, mus musculus
gacaaacattcccatctaaaatgcc

SEQ ID NO: 110556 - DNA, 25 bp, mus musculus
catctaaaatgccaccatttgaagt

SEQ ID NO: 110557 - DNA, 25 bp, mus musculus
gaggcctcctatgaaactccagaag

SEQ ID NO: 110558 - DNA, 25 bp, mus musculus
caaaggcccaattctatgcctgtat

SEQ ID NO: 110559 - DNA, 25 bp, mus musculus
cccaattctatgcctgtattaatgg

SEQ ID NO: 110560 - DNA, 25 bp, mus musculus
tctatgcctgtattaatgggttcta

SEQ ID NO: 110561 - DNA, 25 bp, mus musculus
tatgatttctgtgtctggaatttgc

SEQ ID NO: 110562 - DNA, 25 bp, mus musculus
ttctgtgtctggaatttgcattctg

SEQ ID NO: 110563 - DNA, 25 bp, mus musculus
aatttgcattctgctaaatatcaca

SEQ ID NO: 110564 - DNA, 25 bp, mus musculus
agagctgtgctatttgttcgttagg

SEQ ID NO: 110565 - DNA, 25 bp, mus musculus
gtgctatttgttcgttaggtattgc

SEQ ID NO: 110566 - DNA, 25 bp, mus musculus
ctaatgcattgcctggctgctagag

SEQ ID NO: 110567 - DNA, 25 bp, mus musculus
cattgcctggctgctagagcaaaga

SEQ ID NO: 110568 - DNA, 25 bp, mus musculus
gatgaggcaacccatgcttagtcgc

SEQ ID NO: 110569 - DNA, 25 bp, mus musculus
actatcaggtactctatctacaagg

SEQ ID NO: 110570 - DNA, 25 bp, mus musculus
tactctatctacaaggacccagcag

SEQ ID NO: 110571 - DNA, 25 bp, mus musculus
gtccacaacagtgtgtacacggccc

SEQ ID NO: 110572 - DNA, 25 bp, mus musculus
tacacggccctgttcctggccatcg

SEQ ID NO: 110573 - DNA, 25 bp, mus musculus
ctgttcctggccatcgacagtggca

SEQ ID NO: 110574 - DNA, 25 bp, mus musculus
ttcctggccatcgacagtggcaacc

SEQ ID NO: 110575 - DNA, 25 bp, mus musculus
gacagtggcaaccctcctgcaactg

SEQ ID NO: 110576 - DNA, 25 bp, mus musculus
actggcaccgggactctgctgataa

SEQ ID NO: 110577 - DNA, 25 bp, mus musculus
actctgctgataaccctagaggaca

SEQ ID NO: 110578 - DNA, 25 bp, mus musculus
actgtggctgaggtctgcgatgatg

SEQ ID NO: 110579 - DNA, 25 bp, mus musculus
gatgatgccagaaacctcagcgtgg

SEQ ID NO: 110580 - DNA, 25 bp, mus musculus
aacctcagcgtggtcattctggggg

SEQ ID NO: 110581 - DNA, 25 bp, mus musculus
atctacaaggacccagcaggctggc

SEQ ID NO: 110582 - DNA, 25 bp, mus musculus
gacccagcaggctggctgagtatca

SEQ ID NO: 110583 - DNA, 25 bp, mus musculus
tggctgagtatcaaccccatcaatg

SEQ ID NO: 110584 - DNA, 25 bp, mus musculus
ctgagtatcaaccccatcaatggaa

SEQ ID NO: 110585 - DNA, 25 bp, mus musculus
cccatcaatggaacggtggacacca

SEQ ID NO: 110586 - DNA, 25 bp, mus musculus
gacaccacagctgtgttggaccggg

SEQ ID NO: 110587 - DNA, 25 bp, mus musculus
accacagctgtgttggaccgggagt

SEQ ID NO: 110588 - DNA, 25 bp, mus musculus
ccattcgtccacaacagtgtgtaca

SEQ ID NO: 110589 - DNA, 25 bp, mus musculus
aaggtgtaccactgtgaggcgactg

SEQ ID NO: 110590 - DNA, 25 bp, mus musculus
actgtttttgcacgaaagcatccat

SEQ ID NO: 110591 - DNA, 25 bp, mus musculus
gctccataccaaacaggcagtgagc

SEQ ID NO: 110592 - DNA, 25 bp, mus musculus
taccaaacaggcagtgagcatgttt

SEQ ID NO: 110593 - DNA, 25 bp, mus musculus
catgtttgtgagagccgtggaagaa

SEQ ID NO: 110594 - DNA, 25 bp, mus musculus
gtttgtgagagccgtggaagaagcc

SEQ ID NO: 110595 - DNA, 25 bp, mus musculus
cacagtggtctatgggggcaaggtc

SEQ ID NO: 110596 - DNA, 25 bp, mus musculus
caaggtcatggaccaccctggcaat

SEQ ID NO: 110597 - DNA, 25 bp, mus musculus
ggtcatggaccaccctggcaattac

SEQ ID NO: 110598 - DNA, 25 bp, mus musculus
catggaccaccctggcaattacgtg

SEQ ID NO: 110599 - DNA, 25 bp, mus musculus
caattacgtggaacccaccattgtg

SEQ ID NO: 110600 - DNA, 25 bp, mus musculus
caccattgtgaccggtcttgcccat

SEQ ID NO: 110601 - DNA, 25 bp, mus musculus
gagaagtgcctactcacagatccgt

SEQ ID NO: 110602 - DNA, 25 bp, mus musculus
cattgtgaccggtcttgcccatgat

SEQ ID NO: 110603 - DNA, 25 bp, mus musculus
aagtgcctactcacagatccgtgtc

SEQ ID NO: 110604 - DNA, 25 bp, mus musculus
ggaccccaatatcctctatggaccg

SEQ ID NO: 110605 - DNA, 25 bp, mus musculus
caatatcctctatggaccgctccat

SEQ ID NO: 110606 - DNA, 25 bp, mus musculus
tatcctctatggaccgctccatacc

SEQ ID NO: 110607 - DNA, 25 bp, mus musculus
ctatggaccgctccataccaaacag

SEQ ID NO: 110608 - DNA, 25 bp, mus musculus
tggaccgctccataccaaacaggca

SEQ ID NO: 110609 - DNA, 25 bp, mus musculus
accgctccataccaaacaggcagtg

SEQ ID NO: 110610 - DNA, 25 bp, mus musculus
ggaagagccgcctatagaagaggct

SEQ ID NO: 110611 - DNA, 25 bp, mus musculus
aaccaagcaagggctgtctgctgag

SEQ ID NO: 110612 - DNA, 25 bp, mus musculus
caccatatgacctggtgcagaagaa

SEQ ID NO: 110613 - DNA, 25 bp, mus musculus
ctccagccaatacagaccaagataa

SEQ ID NO: 110614 - DNA, 25 bp, mus musculus
ccaatacagaccaagataaacccag

SEQ ID NO: 110615 - DNA, 25 bp, mus musculus
cagaccaagataaacccagctggtg

SEQ ID NO: 110616 - DNA, 25 bp, mus musculus
aacccagctggtgccaatatacttt

SEQ ID NO: 110617 - DNA, 25 bp, mus musculus
atactttgagtcttatgtgtccctt

SEQ ID NO: 110618 - DNA, 25 bp, mus musculus
ctagaacaatgcacgctgtacaact

SEQ ID NO: 110619 - DNA, 25 bp, mus musculus
acctgtatgcgctgtcaaggtaaac

SEQ ID NO: 110620 - DNA, 25 bp, mus musculus
gtcctagtgacgttcctatgcctgc

SEQ ID NO: 110621 - DNA, 25 bp, mus musculus
tgcctgccctggtcttctatcccaa

SEQ ID NO: 110622 - DNA, 25 bp, mus musculus
accctcactctgtccggagctgaca

SEQ ID NO: 110623 - DNA, 25 bp, mus musculus
cctggtcttctatcccaactgctgt

SEQ ID NO: 110624 - DNA, 25 bp, mus musculus
tccggagctgacaaccgatgacaat

SEQ ID NO: 110625 - DNA, 25 bp, mus musculus
gctgacaaccgatgacaatcggccc

SEQ ID NO: 110626 - DNA, 25 bp, mus musculus
tgacaatcggcccttgagcaggctg

SEQ ID NO: 110627 - DNA, 25 bp, mus musculus
tcggcccttgagcaggctgagtaaa

SEQ ID NO: 110628 - DNA, 25 bp, mus musculus
agccagcagcagggccaggtcagat

SEQ ID NO: 110629 - DNA, 25 bp, mus musculus
cagcagggccaggtcagatgatctc

SEQ ID NO: 110630 - DNA, 25 bp, mus musculus
gtcagatgatctcaccatatgacct

SEQ ID NO: 110631 - DNA, 25 bp, mus musculus
ctgtagttccgtgacctgaaatgga

SEQ ID NO: 110632 - DNA, 25 bp, mus musculus
ttccgtgacctgaaatggacctgtt

SEQ ID NO: 110633 - DNA, 25 bp, mus musculus
gctctgctctattcttcaggatggt

SEQ ID NO: 110634 - DNA, 25 bp, mus musculus
ctgctctattcttcaggatggtcat

SEQ ID NO: 110635 - DNA, 25 bp, mus musculus
aagcaggctcaacacctgtgcctca

SEQ ID NO: 110636 - DNA, 25 bp, mus musculus
caggctcaacacctgtgcctcaggg

SEQ ID NO: 110637 - DNA, 25 bp, mus musculus
gctcaacacctgtgcctcagggtga

SEQ ID NO: 110638 - DNA, 25 bp, mus musculus
cacctgtgcctcagggtgacagaac

SEQ ID NO: 110639 - DNA, 25 bp, mus musculus
ctgtgcctcagggtgacagaactgg

SEQ ID NO: 110640 - DNA, 25 bp, mus musculus
aaccaagcctggctgaaggttctgg

SEQ ID NO: 110641 - DNA, 25 bp, mus musculus
caagcctggctgaaggttctggtgt

SEQ ID NO: 110642 - DNA, 25 bp, mus musculus
gcctggctgaaggttctggtgtttg

SEQ ID NO: 110643 - DNA, 25 bp, mus musculus
tggacctgttgggaccgcctgaagg

SEQ ID NO: 110644 - DNA, 25 bp, mus musculus
acactgaagtcactgctggcccatc

SEQ ID NO: 110645 - DNA, 25 bp, mus musculus
ctgaagtcactgctggcccatctcc

SEQ ID NO: 110646 - DNA, 25 bp, mus musculus
tcactgctggcccatctccaggaag

SEQ ID NO: 110647 - DNA, 25 bp, mus musculus
ctgctggcccatctccaggaagaac

SEQ ID NO: 110648 - DNA, 25 bp, mus musculus
catctccaggaagaacatggactga

SEQ ID NO: 110649 - DNA, 25 bp, mus musculus
caccaccaggctctgctctattctt

SEQ ID NO: 110650 - DNA, 25 bp, mus musculus
caggctctgctctattcttcaggat

SEQ ID NO: 110651 - DNA, 25 bp, mus musculus
gcgccaggtttccgcagcagcccag

SEQ ID NO: 110652 - DNA, 25 bp, mus musculus
ctccacgtgagcctcgctaacggca

SEQ ID NO: 110653 - DNA, 25 bp, mus musculus
tggactatgactcggtgcagccata

SEQ ID NO: 110654 - DNA, 25 bp, mus musculus
tatgactcggtgcagccatacttca

SEQ ID NO: 110655 - DNA, 25 bp, mus musculus
atgactcggtgcagccatacttcat

SEQ ID NO: 110656 - DNA, 25 bp, mus musculus
gactcggtgcagccatacttcatgt

SEQ ID NO: 110657 - DNA, 25 bp, mus musculus
actcggtgcagccatacttcatgtg

SEQ ID NO: 110658 - DNA, 25 bp, mus musculus
tcggtgcagccatacttcatgtgcg

SEQ ID NO: 110659 - DNA, 25 bp, mus musculus
cggtgcagccatacttcatgtgcga

SEQ ID NO: 110660 - DNA, 25 bp, mus musculus
tgcagccatacttcatgtgcgacga

SEQ ID NO: 110661 - DNA, 25 bp, mus musculus
agccatacttcatgtgcgacgatga

SEQ ID NO: 110662 - DNA, 25 bp, mus musculus
acttcatgtgcgacgatgaggagga

SEQ ID NO: 110663 - DNA, 25 bp, mus musculus
ctcgctaacggcaaccgcgacctgg

SEQ ID NO: 110664 - DNA, 25 bp, mus musculus
tcgctaacggcaaccgcgacctgga

SEQ ID NO: 110665 - DNA, 25 bp, mus musculus
gctaacggcaaccgcgacctggact

SEQ ID NO: 110666 - DNA, 25 bp, mus musculus
aacggcaaccgcgacctggactatg

SEQ ID NO: 110667 - DNA, 25 bp, mus musculus
acggcaaccgcgacctggactatga

SEQ ID NO: 110668 - DNA, 25 bp, mus musculus
gcgacctggactatgactcggtgca

SEQ ID NO: 110669 - DNA, 25 bp, mus musculus
acctggactatgactcggtgcagcc

SEQ ID NO: 110670 - DNA, 25 bp, mus musculus
ctggactatgactcggtgcagccat

SEQ ID NO: 110671 - DNA, 25 bp, mus musculus
gctgaagcactacgggcctggctgg

SEQ ID NO: 110672 - DNA, 25 bp, mus musculus
catggccaatgcaggcaaagacacc

SEQ ID NO: 110673 - DNA, 25 bp, mus musculus
cgccattgccaaggagtagagagcc

SEQ ID NO: 110674 - DNA, 25 bp, mus musculus
atccctctaagcagctgtctgtgtg

SEQ ID NO: 110675 - DNA, 25 bp, mus musculus
ctaagcagctgtctgtgtgggtcct

SEQ ID NO: 110676 - DNA, 25 bp, mus musculus
tagccagtcacaaggttctgtgcca

SEQ ID NO: 110677 - DNA, 25 bp, mus musculus
aggttctgtgccaccctggccctag

SEQ ID NO: 110678 - DNA, 25 bp, mus musculus
accctggccctagtgcttccatctg

SEQ ID NO: 110679 - DNA, 25 bp, mus musculus
gccctagtgcttccatctgatgggg

SEQ ID NO: 110680 - DNA, 25 bp, mus musculus
gtgcttccatctgatggggtgacca

SEQ ID NO: 110681 - DNA, 25 bp, mus musculus
ctcacattccacaggcctgattttt

SEQ ID NO: 110682 - DNA, 25 bp, mus musculus
aaactaccaatgctgatcaataaag

SEQ ID NO: 110683 - DNA, 25 bp, mus musculus
ctcacagttcttcataaccacagtc

SEQ ID NO: 110684 - DNA, 25 bp, mus musculus
gttcttcataaccacagtcaagacc

SEQ ID NO: 110685 - DNA, 25 bp, mus musculus
cataaccacagtcaagacctcctgg

SEQ ID NO: 110686 - DNA, 25 bp, mus musculus
cacagtcaagacctcctggctggat

SEQ ID NO: 110687 - DNA, 25 bp, mus musculus
ctcctggctggatggcaagcatgtg

SEQ ID NO: 110688 - DNA, 25 bp, mus musculus
caagacagacagccgggacaagcca

SEQ ID NO: 110689 - DNA, 25 bp, mus musculus
tgtcgactccggcaagatcgaagtg

SEQ ID NO: 110690 - DNA, 25 bp, mus musculus
acccttcgccattgccaaggagtag

SEQ ID NO: 110691 - DNA, 25 bp, mus musculus
gaccagagccacctctgaggggtca

SEQ ID NO: 110692 - DNA, 25 bp, mus musculus
cagagccacctctgaggggtcaaag

SEQ ID NO: 110693 - DNA, 25 bp, mus musculus
accctgcaaactgtcctctacagtc

SEQ ID NO: 110694 - DNA, 25 bp, mus musculus
ctgcaaactgtcctctacagtcttc

SEQ ID NO: 110695 - DNA, 25 bp, mus musculus
actgtcctctacagtcttcaggagg

SEQ ID NO: 110696 - DNA, 25 bp, mus musculus
ctctacagtcttcaggaggagcaag

SEQ ID NO: 110697 - DNA, 25 bp, mus musculus
gagcaagccaggctcaagatgaggc

SEQ ID NO: 110698 - DNA, 25 bp, mus musculus
caagccaggctcaagatgaggctgc

SEQ ID NO: 110699 - DNA, 25 bp, mus musculus
cccggagccaagatcccattctcag

SEQ ID NO: 110700 - DNA, 25 bp, mus musculus
gccaagatcccattctcagtacctg

SEQ ID NO: 110701 - DNA, 25 bp, mus musculus
aagatcccattctcagtacctgaag

SEQ ID NO: 110702 - DNA, 25 bp, mus musculus
atcccattctcagtacctgaagttc

SEQ ID NO: 110703 - DNA, 25 bp, mus musculus
gagtttagtccttcagaactcttca

SEQ ID NO: 110704 - DNA, 25 bp, mus musculus
tcagaactcttcactgccaaccctg

SEQ ID NO: 110705 - DNA, 25 bp, mus musculus
aagccccagcttctgccagacgtga

SEQ ID NO: 110706 - DNA, 25 bp, mus musculus
cagcttctgccagacgtgagagcca

SEQ ID NO: 110707 - DNA, 25 bp, mus musculus
ctgccagacgtgagagccatgtctg

SEQ ID NO: 110708 - DNA, 25 bp, mus musculus
agagccatgtctgtgaccctgcaaa

SEQ ID NO: 110709 - DNA, 25 bp, mus musculus
gccatgtctgtgaccctgcaaactg

SEQ ID NO: 110710 - DNA, 25 bp, mus musculus
gtgaccctgcaaactgtcctctaca

SEQ ID NO: 110711 - DNA, 25 bp, mus musculus
tcatcgcaccatggcggaccgtttg

SEQ ID NO: 110712 - DNA, 25 bp, mus musculus
catcgcaccatggcggaccgtttgt

SEQ ID NO: 110713 - DNA, 25 bp, mus musculus
aacacagagatccactttccagcgg

SEQ ID NO: 110714 - DNA, 25 bp, mus musculus
acacagagatccactttccagcggg

SEQ ID NO: 110715 - DNA, 25 bp, mus musculus
acagagatccactttccagcgggaa

SEQ ID NO: 110716 - DNA, 25 bp, mus musculus
cagagatccactttccagcgggaat

SEQ ID NO: 110717 - DNA, 25 bp, mus musculus
agagatccactttccagcgggaata

SEQ ID NO: 110718 - DNA, 25 bp, mus musculus
agatccactttccagcgggaataga

SEQ ID NO: 110719 - DNA, 25 bp, mus musculus
gtaagttcactgggtgacgctggac

SEQ ID NO: 110720 - DNA, 25 bp, mus musculus
taagttcactgggtgacgctggacg

SEQ ID NO: 110721 - DNA, 25 bp, mus musculus
aagttcactgggtgacgctggacgg

SEQ ID NO: 110722 - DNA, 25 bp, mus musculus
agttcactgggtgacgctggacgga

SEQ ID NO: 110723 - DNA, 25 bp, mus musculus
atcgcaccatggcggaccgtttgtc

SEQ ID NO: 110724 - DNA, 25 bp, mus musculus
cgcaccatggcggaccgtttgtcgg

SEQ ID NO: 110725 - DNA, 25 bp, mus musculus
gggctttgcaccaggcaggtgcgta

SEQ ID NO: 110726 - DNA, 25 bp, mus musculus
gctttgcaccaggcaggtgcgtagc

SEQ ID NO: 110727 - DNA, 25 bp, mus musculus
ctttgcaccaggcaggtgcgtagca

SEQ ID NO: 110728 - DNA, 25 bp, mus musculus
tttgcaccaggcaggtgcgtagcat

SEQ ID NO: 110729 - DNA, 25 bp, mus musculus
tgcaccaggcaggtgcgtagcatga

SEQ ID NO: 110730 - DNA, 25 bp, mus musculus
gaacacagagatccactttccagcg

SEQ ID NO: 110731 - DNA, 25 bp, mus musculus
atgtcaccagctttgaaggctccaa

SEQ ID NO: 110732 - DNA, 25 bp, mus musculus
ccactgccctggacaccaatagttc

SEQ ID NO: 110733 - DNA, 25 bp, mus musculus
tccaggactgagagtcccagggccc

SEQ ID NO: 110734 - DNA, 25 bp, mus musculus
agtcccagggccctcactgcaggta

SEQ ID NO: 110735 - DNA, 25 bp, mus musculus
agggccctcactgcaggtacaagca

SEQ ID NO: 110736 - DNA, 25 bp, mus musculus
aggttccatgaggtcctgtgggatt

SEQ ID NO: 110737 - DNA, 25 bp, mus musculus
catgaggtcctgtgggatttcctgt

SEQ ID NO: 110738 - DNA, 25 bp, mus musculus
ttcctgtgcctactgcagtagcccc

SEQ ID NO: 110739 - DNA, 25 bp, mus musculus
tgcctactgcagtagccccatctgt

SEQ ID NO: 110740 - DNA, 25 bp, mus musculus
catctgtcacagtcactcatcaaaa

SEQ ID NO: 110741 - DNA, 25 bp, mus musculus
tcacagtcactcatcaaaaatcatt

SEQ ID NO: 110742 - DNA, 25 bp, mus musculus
tcactcatcaaaaatcattaaagtc

SEQ ID NO: 110743 - DNA, 25 bp, mus musculus
ttccctgtgcctcaggggcctttag

SEQ ID NO: 110744 - DNA, 25 bp, mus musculus
atcattaaagtctcacgtgcttctc

SEQ ID NO: 110745 - DNA, 25 bp, mus musculus
gtgcctcaggggcctttagcagctt

SEQ ID NO: 110746 - DNA, 25 bp, mus musculus
cctttagcagcttccgtgtggtcat

SEQ ID NO: 110747 - DNA, 25 bp, mus musculus
ctaacctccactgacatggtgtaaa

SEQ ID NO: 110748 - DNA, 25 bp, mus musculus
tcgcctccagctgctttgtaagcat

SEQ ID NO: 110749 - DNA, 25 bp, mus musculus
ccagctgctttgtaagcataaactg

SEQ ID NO: 110750 - DNA, 25 bp, mus musculus
gtttcagccagcactcactccagga

SEQ ID NO: 110751 - DNA, 25 bp, mus musculus
gccagcactcactccaggactgaga

SEQ ID NO: 110752 - DNA, 25 bp, mus musculus
acagcagttgcaccttaaatcttgg

SEQ ID NO: 110753 - DNA, 25 bp, mus musculus
gcagttgcaccttaaatcttggcct

SEQ ID NO: 110754 - DNA, 25 bp, mus musculus
tggggcctctttggtcgaaagacag

SEQ ID NO: 110755 - DNA, 25 bp, mus musculus
caagcaccaggattttcttacacgg

SEQ ID NO: 110756 - DNA, 25 bp, mus musculus
ccaggattttcttacacggatgcaa

SEQ ID NO: 110757 - DNA, 25 bp, mus musculus
caggccacatcctcatgaagtgaag

SEQ ID NO: 110758 - DNA, 25 bp, mus musculus
gccacatcctcatgaagtgaagtag

SEQ ID NO: 110759 - DNA, 25 bp, mus musculus
acatcctcatgaagtgaagtagtat

SEQ ID NO: 110760 - DNA, 25 bp, mus musculus
tttcagcttcaaaatattcgctacc

SEQ ID NO: 110761 - DNA, 25 bp, mus musculus
aatattcgctaccagtttcaaatat

SEQ ID NO: 110762 - DNA, 25 bp, mus musculus
attcgctaccagtttcaaatattgt

SEQ ID NO: 110763 - DNA, 25 bp, mus musculus
cgctaccagtttcaaatattgtgtt

SEQ ID NO: 110764 - DNA, 25 bp, mus musculus
gcaccttaaatcttggcctccctgc

SEQ ID NO: 110765 - DNA, 25 bp, mus musculus
taaatcttggcctccctgcatcagt

SEQ ID NO: 110766 - DNA, 25 bp, mus musculus
gcctccctgcatcagtggaccaagg

SEQ ID NO: 110767 - DNA, 25 bp, mus musculus
ctgcatcagtggaccaagggtggcc

SEQ ID NO: 110768 - DNA, 25 bp, mus musculus
catcagtggaccaagggtggcccag

SEQ ID NO: 110769 - DNA, 25 bp, mus musculus
cacggctgctgtgattgtgaataca

SEQ ID NO: 110770 - DNA, 25 bp, mus musculus
acaggtccaaatctctggggcctct

SEQ ID NO: 110771 - DNA, 25 bp, mus musculus
ggtccaaatctctggggcctctttg

SEQ ID NO: 110772 - DNA, 25 bp, mus musculus
gcggaacctgcaagcccatttgatg

SEQ ID NO: 110773 - DNA, 25 bp, mus musculus
gaacctgcaagcccatttgatgtac

SEQ ID NO: 110774 - DNA, 25 bp, mus musculus
tgcccgagctctagaaatgcacctg

SEQ ID NO: 110775 - DNA, 25 bp, mus musculus
agctctagaaatgcacctgaattca

SEQ ID NO: 110776 - DNA, 25 bp, mus musculus
gaattcacacagtggtgtgaaaatg

SEQ ID NO: 110777 - DNA, 25 bp, mus musculus
tttaaaatgcacggtctgtagctac

SEQ ID NO: 110778 - DNA, 25 bp, mus musculus
cacggtctgtagctacactgctgat

SEQ ID NO: 110779 - DNA, 25 bp, mus musculus
ggtctgtagctacactgctgattct

SEQ ID NO: 110780 - DNA, 25 bp, mus musculus
ctgtagctacactgctgattctgtg

SEQ ID NO: 110781 - DNA, 25 bp, mus musculus
cactgctgattctgtgatcaacttc

SEQ ID NO: 110782 - DNA, 25 bp, mus musculus
ttctgtgatcaacttccacctacac

SEQ ID NO: 110783 - DNA, 25 bp, mus musculus
tgtgatcaacttccacctacacctg

SEQ ID NO: 110784 - DNA, 25 bp, mus musculus
gcaagcccatttgatgtactactgt

SEQ ID NO: 110785 - DNA, 25 bp, mus musculus
acgagaagctgctccagtgtcagaa

SEQ ID NO: 110786 - DNA, 25 bp, mus musculus
cttcccacaatgcaccaagagcttt

SEQ ID NO: 110787 - DNA, 25 bp, mus musculus
atgcaccaagagcttttccaatgcc

SEQ ID NO: 110788 - DNA, 25 bp, mus musculus
caccaagagcttttccaatgcccga

SEQ ID NO: 110789 - DNA, 25 bp, mus musculus
gagcttttccaatgcccgagctcta

SEQ ID NO: 110790 - DNA, 25 bp, mus musculus
cttttccaatgcccgagctctagaa

SEQ ID NO: 110791 - DNA, 25 bp, mus musculus
ttccaatgcccgagctctagaaatg

SEQ ID NO: 110792 - DNA, 25 bp, mus musculus
ccacctgcatgttcgtggcctctaa

SEQ ID NO: 110793 - DNA, 25 bp, mus musculus
cctgcatgttcgtggcctctaagat

SEQ ID NO: 110794 - DNA, 25 bp, mus musculus
cgcactttctttccagagtcatcaa

SEQ ID NO: 110795 - DNA, 25 bp, mus musculus
actttctttccagagtcatcaagtg

SEQ ID NO: 110796 - DNA, 25 bp, mus musculus
ttctttccagagtcatcaagtgtga

SEQ ID NO: 110797 - DNA, 25 bp, mus musculus
tcatcaagtgtgacccggactgcct

SEQ ID NO: 110798 - DNA, 25 bp, mus musculus
tcaagtgtgacccggactgcctccg

SEQ ID NO: 110799 - DNA, 25 bp, mus musculus
aacagattgaagcccttctggagtc

SEQ ID NO: 110800 - DNA, 25 bp, mus musculus
agattgaagcccttctggagtcaag

SEQ ID NO: 110801 - DNA, 25 bp, mus musculus
tgcgccaggcccagcagaacgtcga

SEQ ID NO: 110802 - DNA, 25 bp, mus musculus
tcgaccccaaggccactgaggagga

SEQ ID NO: 110803 - DNA, 25 bp, mus musculus
ccaccgacgtgcgagatgtggacat

SEQ ID NO: 110804 - DNA, 25 bp, mus musculus
gcatgttcgtggcctctaagatgaa

SEQ ID NO: 110805 - DNA, 25 bp, mus musculus
tgttcgtggcctctaagatgaagga

SEQ ID NO: 110806 - DNA, 25 bp, mus musculus
aggagaccattcccttgactgccga

SEQ ID NO: 110807 - DNA, 25 bp, mus musculus
agaccattcccttgactgccgagaa

SEQ ID NO: 110808 - DNA, 25 bp, mus musculus
ccattcccttgactgccgagaagtt

SEQ ID NO: 110809 - DNA, 25 bp, mus musculus
ttcccttgactgccgagaagttgtg

SEQ ID NO: 110810 - DNA, 25 bp, mus musculus
gcatctacactgacaactctatccg

SEQ ID NO: 110811 - DNA, 25 bp, mus musculus
tggaactgcttctggtgaacaagct

SEQ ID NO: 110812 - DNA, 25 bp, mus musculus
tggaaaacccgaggcgaatatcgca

SEQ ID NO: 110813 - DNA, 25 bp, mus musculus
ggcgaatatcgcacaccatcgggga

SEQ ID NO: 110814 - DNA, 25 bp, mus musculus
cctgacaagatcacgcacatctcta

SEQ ID NO: 110815 - DNA, 25 bp, mus musculus
gacaagatcacgcacatctctaaga

SEQ ID NO: 110816 - DNA, 25 bp, mus musculus
atcacgcacatctctaagacatcct

SEQ ID NO: 110817 - DNA, 25 bp, mus musculus
acgcacatctctaagacatccttga

SEQ ID NO: 110818 - DNA, 25 bp, mus musculus
atctctaagacatccttgagtgtca

SEQ ID NO: 110819 - DNA, 25 bp, mus musculus
tctaagacatccttgagtgtcaggt

SEQ ID NO: 110820 - DNA, 25 bp, mus musculus
aagacatccttgagtgtcaggtgaa

SEQ ID NO: 110821 - DNA, 25 bp, mus musculus
acatccttgagtgtcaggtgaacca

SEQ ID NO: 110822 - DNA, 25 bp, mus musculus
tgaaccaccacaatccggtgaaccg

SEQ ID NO: 110823 - DNA, 25 bp, mus musculus
aaagcatgaccgggctatccggcac

SEQ ID NO: 110824 - DNA, 25 bp, mus musculus
gaatatcgcacaccatcggggagca

SEQ ID NO: 110825 - DNA, 25 bp, mus musculus
tatcgcacaccatcggggagcaagc

SEQ ID NO: 110826 - DNA, 25 bp, mus musculus
cgcacaccatcggggagcaagctct

SEQ ID NO: 110827 - DNA, 25 bp, mus musculus
ctctcctgcccataagcgaggtcca

SEQ ID NO: 110828 - DNA, 25 bp, mus musculus
tgcccataagcgaggtccaacgcca

SEQ ID NO: 110829 - DNA, 25 bp, mus musculus
taagcgaggtccaacgccagcagga

SEQ ID NO: 110830 - DNA, 25 bp, mus musculus
tccaacgccagcaggatacctgaca

SEQ ID NO: 110831 - DNA, 25 bp, mus musculus
atacctgacaagatcacgcacatct

SEQ ID NO: 110832 - DNA, 25 bp, mus musculus
tcgcaagctgccccagcaaaaggag

SEQ ID NO: 110833 - DNA, 25 bp, mus musculus
gtccctgatccgcaagcatgcgcag

SEQ ID NO: 110834 - DNA, 25 bp, mus musculus
catctgtgggcttcagcaggatgat

SEQ ID NO: 110835 - DNA, 25 bp, mus musculus
tgggcttcagcaggatgatgaagtg

SEQ ID NO: 110836 - DNA, 25 bp, mus musculus
tgaagtgaacacactcacgtgtgat

SEQ ID NO: 110837 - DNA, 25 bp, mus musculus
actcacgtgtgatgccctgactgag

SEQ ID NO: 110838 - DNA, 25 bp, mus musculus
ggccaagatcacccacactgatgtg

SEQ ID NO: 110839 - DNA, 25 bp, mus musculus
gatcacccacactgatgtggattgt

SEQ ID NO: 110840 - DNA, 25 bp, mus musculus
tctcaaagcctgccaggagcaaatc

SEQ ID NO: 110841 - DNA, 25 bp, mus musculus
gttccgtcaagagcagcataacgcc

SEQ ID NO: 110842 - DNA, 25 bp, mus musculus
gcagcataacgccggatccaagtct

SEQ ID NO: 110843 - DNA, 25 bp, mus musculus
aagccattcgggcggcaagagagag

SEQ ID NO: 110844 - DNA, 25 bp, mus musculus
caagcatgcgcagaccttcatcgct

SEQ ID NO: 110845 - DNA, 25 bp, mus musculus
tgcgcagaccttcatcgctctgtgc

SEQ ID NO: 110846 - DNA, 25 bp, mus musculus
gaccttcatcgctctgtgcgctacc

SEQ ID NO: 110847 - DNA, 25 bp, mus musculus
catcgctctgtgcgctaccgacttc

SEQ ID NO: 110848 - DNA, 25 bp, mus musculus
cgctaccgacttcaagtttgccatg

SEQ ID NO: 110849 - DNA, 25 bp, mus musculus
cgacttcaagtttgccatgtacccg

SEQ ID NO: 110850 - DNA, 25 bp, mus musculus
tgccatgtacccgccatcgatgatt

SEQ ID NO: 110851 - DNA, 25 bp, mus musculus
tgcaactggaagcgtgggagcagcc

SEQ ID NO: 110852 - DNA, 25 bp, mus musculus
tccttcgggcatcccgatagaagct

SEQ ID NO: 110853 - DNA, 25 bp, mus musculus
gggcatcccgatagaagcttatgag

SEQ ID NO: 110854 - DNA, 25 bp, mus musculus
cttgctgcttagcttctgtgattgt

SEQ ID NO: 110855 - DNA, 25 bp, mus musculus
gcttagcttctgtgattgtggggtc

SEQ ID NO: 110856 - DNA, 25 bp, mus musculus
ccctctgctactgctttgtggccca

SEQ ID NO: 110857 - DNA, 25 bp, mus musculus
gctactgctttgtggcccaggagct

SEQ ID NO: 110858 - DNA, 25 bp, mus musculus
tggcccaggagctgctacagcctgg

SEQ ID NO: 110859 - DNA, 25 bp, mus musculus
cctcatcttcatcagagcagggtta

SEQ ID NO: 110860 - DNA, 25 bp, mus musculus
atcgatgccgtggaggtgacagagc

SEQ ID NO: 110861 - DNA, 25 bp, mus musculus
ggcccatttctatcatgctgcctta

SEQ ID NO: 110862 - DNA, 25 bp, mus musculus
tttctatcatgctgccttaataaag

SEQ ID NO: 110863 - DNA, 25 bp, mus musculus
tcatgctgccttaataaagatttcg

SEQ ID NO: 110864 - DNA, 25 bp, mus musculus
gccctagatggcctctgtgtaatcc

SEQ ID NO: 110865 - DNA, 25 bp, mus musculus
gatggcctctgtgtaatccgtactc

SEQ ID NO: 110866 - DNA, 25 bp, mus musculus
ctctgtgtaatccgtactccagctg

SEQ ID NO: 110867 - DNA, 25 bp, mus musculus
cgtactccagctgctcttagaggga

SEQ ID NO: 110868 - DNA, 25 bp, mus musculus
ccagctgctcttagagggaacagcc

SEQ ID NO: 110869 - DNA, 25 bp, mus musculus
cagagcaagaacccatacactgttg

SEQ ID NO: 110870 - DNA, 25 bp, mus musculus
actgttgctttgcttgctgcttagc

SEQ ID NO: 110871 - DNA, 25 bp, mus musculus
gctttgcttgctgcttagcttctgt

SEQ ID NO: 110872 - DNA, 25 bp, mus musculus
agggtcagcctctcagctacagact

SEQ ID NO: 110873 - DNA, 25 bp, mus musculus
gtcagcctctcagctacagactgct

SEQ ID NO: 110874 - DNA, 25 bp, mus musculus
gtatgcaattgcctgcacaagacgg

SEQ ID NO: 110875 - DNA, 25 bp, mus musculus
tgcaattgcctgcacaagacggccg

SEQ ID NO: 110876 - DNA, 25 bp, mus musculus
tgcctgcacaagacggccgtgttgg

SEQ ID NO: 110877 - DNA, 25 bp, mus musculus
cacaagacggccgtgttggcaggta

SEQ ID NO: 110878 - DNA, 25 bp, mus musculus
acggccgtgttggcaggtactgcgt

SEQ ID NO: 110879 - DNA, 25 bp, mus musculus
gtgttggcaggtactgcgtgcctct

SEQ ID NO: 110880 - DNA, 25 bp, mus musculus
gcaggtactgcgtgcctcttcaccc

SEQ ID NO: 110881 - DNA, 25 bp, mus musculus
ggtactgcgtgcctcttcaccccat

SEQ ID NO: 110882 - DNA, 25 bp, mus musculus
ccattggcactgcccctggattact

SEQ ID NO: 110883 - DNA, 25 bp, mus musculus
ttggcactgcccctggattactccc

SEQ ID NO: 110884 - DNA, 25 bp, mus musculus
ctctcagctacagactgctacattg

SEQ ID NO: 110885 - DNA, 25 bp, mus musculus
gactgctacattgtgcacgaaatct

SEQ ID NO: 110886 - DNA, 25 bp, mus musculus
aacgcccaggaccagtttgagtatg

SEQ ID NO: 110887 - DNA, 25 bp, mus musculus
ctggaagcccagtacaagtacattg

SEQ ID NO: 110888 - DNA, 25 bp, mus musculus
gagacagcacgctggatcaccgtat

SEQ ID NO: 110889 - DNA, 25 bp, mus musculus
gcacgctggatcaccgtatgcaatt

SEQ ID NO: 110890 - DNA, 25 bp, mus musculus
cgctggatcaccgtatgcaattgcc

SEQ ID NO: 110891 - DNA, 25 bp, mus musculus
tggatcaccgtatgcaattgcctgc

SEQ ID NO: 110892 - DNA, 25 bp, mus musculus
ttactctcgagacagccagttcgcc

SEQ ID NO: 110893 - DNA, 25 bp, mus musculus
actctcgagacagccagttcgcccg

SEQ ID NO: 110894 - DNA, 25 bp, mus musculus
tggctgaacaggccgaacggtatga

SEQ ID NO: 110895 - DNA, 25 bp, mus musculus
gctgaacaggccgaacggtatgaag

SEQ ID NO: 110896 - DNA, 25 bp, mus musculus
aacaggccgaacggtatgaagacat

SEQ ID NO: 110897 - DNA, 25 bp, mus musculus
gacatggcagctttcatgaagagcg

SEQ ID NO: 110898 - DNA, 25 bp, mus musculus
ctttcatgaagagcgccgtggaaaa

SEQ ID NO: 110899 - DNA, 25 bp, mus musculus
aggagctctcctgcgaggagcgaaa

SEQ ID NO: 110900 - DNA, 25 bp, mus musculus
gctctcctgcgaggagcgaaacctg

SEQ ID NO: 110901 - DNA, 25 bp, mus musculus
tctcctgcgaggagcgaaacctgct

SEQ ID NO: 110902 - DNA, 25 bp, mus musculus
ctgctttccgtagcttacaagaacg

SEQ ID NO: 110903 - DNA, 25 bp, mus musculus
gtcctgtccagcatcgagcagaaga

SEQ ID NO: 110904 - DNA, 25 bp, mus musculus
tctcgagacagccagttcgcccgtc

SEQ ID NO: 110905 - DNA, 25 bp, mus musculus
tcgagacagccagttcgcccgtctg

SEQ ID NO: 110906 - DNA, 25 bp, mus musculus
ccatcctcgcagtcatggagagagc

SEQ ID NO: 110907 - DNA, 25 bp, mus musculus
cctcgcagtcatggagagagccagt

SEQ ID NO: 110908 - DNA, 25 bp, mus musculus
agagagccagtctgatccagaaggc

SEQ ID NO: 110909 - DNA, 25 bp, mus musculus
agagccagtctgatccagaaggcca

SEQ ID NO: 110910 - DNA, 25 bp, mus musculus
ccagtctgatccagaaggccaagtt

SEQ ID NO: 110911 - DNA, 25 bp, mus musculus
agtctgatccagaaggccaagttgg

SEQ ID NO: 110912 - DNA, 25 bp, mus musculus
aattctggcacagaggtgctcttgc

SEQ ID NO: 110913 - DNA, 25 bp, mus musculus
gtgctcttgccacctgctgaggcta

SEQ ID NO: 110914 - DNA, 25 bp, mus musculus
ttgcatgtccatgtttctcttcagg

SEQ ID NO: 110915 - DNA, 25 bp, mus musculus
tctcttcaggaagggttgagacttg

SEQ ID NO: 110916 - DNA, 25 bp, mus musculus
gactctgaacttgctaccaaaggag

SEQ ID NO: 110917 - DNA, 25 bp, mus musculus
tctgaacttgctaccaaaggaggcc

SEQ ID NO: 110918 - DNA, 25 bp, mus musculus
gaacttgctaccaaaggaggccttg

SEQ ID NO: 110919 - DNA, 25 bp, mus musculus
atacagtcatagactactgcatcag

SEQ ID NO: 110920 - DNA, 25 bp, mus musculus
cagtcatagactactgcatcagctc

SEQ ID NO: 110921 - DNA, 25 bp, mus musculus
actactgcatcagctcttggtctct

SEQ ID NO: 110922 - DNA, 25 bp, mus musculus
ctctcttctttactgtataaaatgt

SEQ ID NO: 110923 - DNA, 25 bp, mus musculus
aagattctaactcaagtattcagaa

SEQ ID NO: 110924 - DNA, 25 bp, mus musculus
ctcttgccacctgctgaggctaaac

SEQ ID NO: 110925 - DNA, 25 bp, mus musculus
ccacctgctgaggctaaacagcctt

SEQ ID NO: 110926 - DNA, 25 bp, mus musculus
gaggctaaacagccttcccaaatgg

SEQ ID NO: 110927 - DNA, 25 bp, mus musculus
ccttcccaaatggtttatgacactg

SEQ ID NO: 110928 - DNA, 25 bp, mus musculus
cacctctgttcaccctacatagaaa

SEQ ID NO: 110929 - DNA, 25 bp, mus musculus
ctctgttcaccctacatagaaacaa

SEQ ID NO: 110930 - DNA, 25 bp, mus musculus
gtgctcctgtccttgcatgtccatg

SEQ ID NO: 110931 - DNA, 25 bp, mus musculus
tccttgcatgtccatgtttctcttc

SEQ ID NO: 110932 - DNA, 25 bp, mus musculus
cctgcaggcatgactgtgatccagt

SEQ ID NO: 110933 - DNA, 25 bp, mus musculus
actgtgatccagtgggtgtcagatt

SEQ ID NO: 110934 - DNA, 25 bp, mus musculus
tgcctgggtggcctgtttgtacctg

SEQ ID NO: 110935 - DNA, 25 bp, mus musculus
ggtggcctgtttgtacctgaggcct

SEQ ID NO: 110936 - DNA, 25 bp, mus musculus
gtacctgaggcctacatcactgcca

SEQ ID NO: 110937 - DNA, 25 bp, mus musculus
gaggcctacatcactgccaccagac

SEQ ID NO: 110938 - DNA, 25 bp, mus musculus
actgccaccagacagtatgtggcac

SEQ ID NO: 110939 - DNA, 25 bp, mus musculus
caagctaacagctggtccctggagg

SEQ ID NO: 110940 - DNA, 25 bp, mus musculus
aacagctggtccctggaggaactct

SEQ ID NO: 110941 - DNA, 25 bp, mus musculus
tggtccctggaggaactctgcctgg

SEQ ID NO: 110942 - DNA, 25 bp, mus musculus
gaactctgcctggaagtcaatgtca

SEQ ID NO: 110943 - DNA, 25 bp, mus musculus
gaagtcaatgtcaccgcctcacaga

SEQ ID NO: 110944 - DNA, 25 bp, mus musculus
atcaaacagctgcagaacatctcac

SEQ ID NO: 110945 - DNA, 25 bp, mus musculus
cagctgcagaacatctcacaagcag

SEQ ID NO: 110946 - DNA, 25 bp, mus musculus
cagaacatctcacaagcagctgcat

SEQ ID NO: 110947 - DNA, 25 bp, mus musculus
atctcacaagcagctgcatctggtg

SEQ ID NO: 110948 - DNA, 25 bp, mus musculus
caagcagctgcatctggtggtgcca

SEQ ID NO: 110949 - DNA, 25 bp, mus musculus
gctgcatctggtggtgccaaggaac

SEQ ID NO: 110950 - DNA, 25 bp, mus musculus
ctgaagaacatccacgtgtgcctgg

SEQ ID NO: 110951 - DNA, 25 bp, mus musculus
aacatccacgtgtgcctgggtggcc

SEQ ID NO: 110952 - DNA, 25 bp, mus musculus
ctggcccatgtgcacatctgtgatc

SEQ ID NO: 110953 - DNA, 25 bp, mus musculus
cacatctgtgatccaccagcagtct

SEQ ID NO: 110954 - DNA, 25 bp, mus musculus
cagcctgggctaacagtaagtttga

SEQ ID NO: 110955 - DNA, 25 bp, mus musculus
aggctagccttgtctgttacataag

SEQ ID NO: 110956 - DNA, 25 bp, mus musculus
gccttgtctgttacataagtaataa

SEQ ID NO: 110957 - DNA, 25 bp, mus musculus
gaacgacatatccttcttttctagt

SEQ ID NO: 110958 - DNA, 25 bp, mus musculus
catatccttcttttctagtggtgct

SEQ ID NO: 110959 - DNA, 25 bp, mus musculus
ttccttgtgatctccatttgggtga

SEQ ID NO: 110960 - DNA, 25 bp, mus musculus
gcattttctgttcaaatagttcttg

SEQ ID NO: 110961 - DNA, 25 bp, mus musculus
tcatgagcattctggggcttggtgt

SEQ ID NO: 110962 - DNA, 25 bp, mus musculus
tgagcattctggggcttggtgttct

SEQ ID NO: 110963 - DNA, 25 bp, mus musculus
gcattctggggcttggtgttcttta

SEQ ID NO: 110964 - DNA, 25 bp, mus musculus
tgtgatccaccagcagtcttttagt

SEQ ID NO: 110965 - DNA, 25 bp, mus musculus
aattttccagtctcgattgcaataa

SEQ ID NO: 110966 - DNA, 25 bp, mus musculus
tcaaccacacagtcagatgtctcaa

SEQ ID NO: 110967 - DNA, 25 bp, mus musculus
tcagatgtctcaacaaacacctgtc

SEQ ID NO: 110968 - DNA, 25 bp, mus musculus
gtctcaacaaacacctgtcatccca

SEQ ID NO: 110969 - DNA, 25 bp, mus musculus
acctgtcatcccagtatttgggaag

SEQ ID NO: 110970 - DNA, 25 bp, mus musculus
catcccagtatttgggaagtgcagg

SEQ ID NO: 110971 - DNA, 25 bp, mus musculus
caaggccagcctgggctaacagtaa

SEQ ID NO: 110972 - DNA, 25 bp, mus musculus
gtcactcctgaagctaagaacttga

SEQ ID NO: 110973 - DNA, 25 bp, mus musculus
gcaaagcgcatcacggccgaccagg

SEQ ID NO: 110974 - DNA, 25 bp, mus musculus
gcatccatgatgcatcgccaagaga

SEQ ID NO: 110975 - DNA, 25 bp, mus musculus
tccatgatgcatcgccaagagacgg

SEQ ID NO: 110976 - DNA, 25 bp, mus musculus
atgatgcatcgccaagagacggtag

SEQ ID NO: 110977 - DNA, 25 bp, mus musculus
atgcatcgccaagagacggtagagt

SEQ ID NO: 110978 - DNA, 25 bp, mus musculus
catcgccaagagacggtagagtgct

SEQ ID NO: 110979 - DNA, 25 bp, mus musculus
tgcttacgcaaattcaacgcccgga

SEQ ID NO: 110980 - DNA, 25 bp, mus musculus
ctcacaaccatgcttgtctccagga

SEQ ID NO: 110981 - DNA, 25 bp, mus musculus
acaaccatgcttgtctccaggaact

SEQ ID NO: 110982 - DNA, 25 bp, mus musculus
accatgcttgtctccaggaactttt

SEQ ID NO: 110983 - DNA, 25 bp, mus musculus
cttgtctccaggaacttttcagctg

SEQ ID NO: 110984 - DNA, 25 bp, mus musculus
gaccaggctctcaagcacccatggg

SEQ ID NO: 110985 - DNA, 25 bp, mus musculus
gtctccaggaacttttcagctgcca

SEQ ID NO: 110986 - DNA, 25 bp, mus musculus
ccatgggtctgtcaacggtctacgg

SEQ ID NO: 110987 - DNA, 25 bp, mus musculus
gtctgtcaacggtctacggtggcat

SEQ ID NO: 110988 - DNA, 25 bp, mus musculus
tgtcaacggtctacggtggcatcca

SEQ ID NO: 110989 - DNA, 25 bp, mus musculus
caacggtctacggtggcatccatga

SEQ ID NO: 110990 - DNA, 25 bp, mus musculus
cggtctacggtggcatccatgatgc

SEQ ID NO: 110991 - DNA, 25 bp, mus musculus
tctacggtggcatccatgatgcatc

SEQ ID NO: 110992 - DNA, 25 bp, mus musculus
gtggcatccatgatgcatcgccaag

SEQ ID NO: 110993 - DNA, 25 bp, mus musculus
aacagtctggagcatacggacaggc

SEQ ID NO: 110994 - DNA, 25 bp, mus musculus
acggacaggcaccactcacacatgc

SEQ ID NO: 110995 - DNA, 25 bp, mus musculus
gacatttcttccagctaaagtcact

SEQ ID NO: 110996 - DNA, 25 bp, mus musculus
atttcttccagctaaagtcactcga

SEQ ID NO: 110997 - DNA, 25 bp, mus musculus
tcttccagctaaagtcactcgatgt

SEQ ID NO: 110998 - DNA, 25 bp, mus musculus
agctaaagtcactcgatgttggcaa

SEQ ID NO: 110999 - DNA, 25 bp, mus musculus
taaagtcactcgatgttggcaaggt

SEQ ID NO: 111000 - DNA, 25 bp, mus musculus
agtcactcgatgttggcaaggtacc

SEQ ID NO: 111001 - DNA, 25 bp, mus musculus
tatgcagttaccagtgttaaatcca

SEQ ID NO: 111002 - DNA, 25 bp, mus musculus
gtacacagcccagcacatgaagctt

SEQ ID NO: 111003 - DNA, 25 bp, mus musculus
cacagcccagcacatgaagctttag

SEQ ID NO: 111004 - DNA, 25 bp, mus musculus
agcccagcacatgaagctttagacg

SEQ ID NO: 111005 - DNA, 25 bp, mus musculus
gacaggcaccactcacacatgcgca

SEQ ID NO: 111006 - DNA, 25 bp, mus musculus
caattacacacaaagaagacagggc

SEQ ID NO: 111007 - DNA, 25 bp, mus musculus
caccactcacacatgcgcagaagca

SEQ ID NO: 111008 - DNA, 25 bp, mus musculus
tcacacatgcgcagaagcagagtct

SEQ ID NO: 111009 - DNA, 25 bp, mus musculus
agagtctactttcagatccacttta

SEQ ID NO: 111010 - DNA, 25 bp, mus musculus
gtctactttcagatccactttattt

SEQ ID NO: 111011 - DNA, 25 bp, mus musculus
cctcctcacatacagagcttctcag

SEQ ID NO: 111012 - DNA, 25 bp, mus musculus
cacatacagagcttctcagacattt

SEQ ID NO: 111013 - DNA, 25 bp, mus musculus
cagagcttctcagacatttcttcca

SEQ ID NO: 111014 - DNA, 25 bp, mus musculus
aatcctttacttgtggctcagttct

SEQ ID NO: 111015 - DNA, 25 bp, mus musculus
ttacttgtggctcagttcttagaaa

SEQ ID NO: 111016 - DNA, 25 bp, mus musculus
tacctgcctctcatgtctaagaaaa

SEQ ID NO: 111017 - DNA, 25 bp, mus musculus
atgctttagacaagctctgtagtaa

SEQ ID NO: 111018 - DNA, 25 bp, mus musculus
gtaatagaccactcacaggtttcac

SEQ ID NO: 111019 - DNA, 25 bp, mus musculus
cactcacaggtttcacactagagaa

SEQ ID NO: 111020 - DNA, 25 bp, mus musculus
tcacaggtttcacactagagaatca

SEQ ID NO: 111021 - DNA, 25 bp, mus musculus
gtttcacactagagaatcatgaaca

SEQ ID NO: 111022 - DNA, 25 bp, mus musculus
tctttttcaactcaaatatttcaca

SEQ ID NO: 111023 - DNA, 25 bp, mus musculus
tcaactcaaatatttcacaatgaca

SEQ ID NO: 111024 - DNA, 25 bp, mus musculus
atatttcacaatgacaacaaaatgg

SEQ ID NO: 111025 - DNA, 25 bp, mus musculus
tttcacaatgacaacaaaatggaga

SEQ ID NO: 111026 - DNA, 25 bp, mus musculus
cttgtggctcagttcttagaaaaca

SEQ ID NO: 111027 - DNA, 25 bp, mus musculus
aaattcatactgcaagaagccttac

SEQ ID NO: 111028 - DNA, 25 bp, mus musculus
ttcatactgcaagaagccttactaa

SEQ ID NO: 111029 - DNA, 25 bp, mus musculus
caagaagccttactaatgcaatgaa

SEQ ID NO: 111030 - DNA, 25 bp, mus musculus
tatccaagaagcctaccttagaact

SEQ ID NO: 111031 - DNA, 25 bp, mus musculus
agaagcctaccttagaactcatcaa

SEQ ID NO: 111032 - DNA, 25 bp, mus musculus
atatagcacagtctttacctgcctc

SEQ ID NO: 111033 - DNA, 25 bp, mus musculus
tagcacagtctttacctgcctctca

SEQ ID NO: 111034 - DNA, 25 bp, mus musculus
tcattcttgagtagcattagggtat

SEQ ID NO: 111035 - DNA, 25 bp, mus musculus
gtatttcaaaactgccaaggggctg

SEQ ID NO: 111036 - DNA, 25 bp, mus musculus
aaagccctgcttgtcctttgacaga

SEQ ID NO: 111037 - DNA, 25 bp, mus musculus
gccctgcttgtcctttgacagaagt

SEQ ID NO: 111038 - DNA, 25 bp, mus musculus
cttgtcctttgacagaagtaaatga

SEQ ID NO: 111039 - DNA, 25 bp, mus musculus
taaatgaaagcgcctctcattcctt

SEQ ID NO: 111040 - DNA, 25 bp, mus musculus
aaagcgcctctcattccttcccgag

SEQ ID NO: 111041 - DNA, 25 bp, mus musculus
actctgtgagtgtccttggggcagc

SEQ ID NO: 111042 - DNA, 25 bp, mus musculus
ctgtgagtgtccttggggcagctac

SEQ ID NO: 111043 - DNA, 25 bp, mus musculus
tgagtgtccttggggcagctacctg

SEQ ID NO: 111044 - DNA, 25 bp, mus musculus
tccttggggcagctacctgcactct

SEQ ID NO: 111045 - DNA, 25 bp, mus musculus
gcactctaaaactgcaaacagaaac

SEQ ID NO: 111046 - DNA, 25 bp, mus musculus
tttcaaaactgccaaggggctgatg

SEQ ID NO: 111047 - DNA, 25 bp, mus musculus
cgcagccgcagttggagaatgccaa

SEQ ID NO: 111048 - DNA, 25 bp, mus musculus
aagacttcgcttcatagtactggag

SEQ ID NO: 111049 - DNA, 25 bp, mus musculus
acttcgcttcatagtactggagcgg

SEQ ID NO: 111050 - DNA, 25 bp, mus musculus
ggcattattgctccatattggagca

SEQ ID NO: 111051 - DNA, 25 bp, mus musculus
attattgctccatattggagcatgt

SEQ ID NO: 111052 - DNA, 25 bp, mus musculus
tttacggatgacgttctgttttctg

SEQ ID NO: 111053 - DNA, 25 bp, mus musculus
gtgaaagccctgcttgtcctttgac

SEQ ID NO: 111054 - DNA, 25 bp, mus musculus
taacagacgtacactgtggagttgg

SEQ ID NO: 111055 - DNA, 25 bp, mus musculus
cagacgtacactgtggagttggtcc

SEQ ID NO: 111056 - DNA, 25 bp, mus musculus
aagccatgtgcaacaagctgccagc

SEQ ID NO: 111057 - DNA, 25 bp, mus musculus
ccatgtgcaacaagctgccagctca

SEQ ID NO: 111058 - DNA, 25 bp, mus musculus
tgtgcaacaagctgccagctcaaga

SEQ ID NO: 111059 - DNA, 25 bp, mus musculus
gcaacaagctgccagctcaagaatg

SEQ ID NO: 111060 - DNA, 25 bp, mus musculus
acaagctgccagctcaagaatgctg

SEQ ID NO: 111061 - DNA, 25 bp, mus musculus
agctgccagctcaagaatgctgatc

SEQ ID NO: 111062 - DNA, 25 bp, mus musculus
tgccagctcaagaatgctgatccag

SEQ ID NO: 111063 - DNA, 25 bp, mus musculus
ctcaagaatgctgatccaggggacg

SEQ ID NO: 111064 - DNA, 25 bp, mus musculus
tctccaactccacagtaaggaaacg

SEQ ID NO: 111065 - DNA, 25 bp, mus musculus
gttcagccaacgaagttcatgacga

SEQ ID NO: 111066 - DNA, 25 bp, mus musculus
acgtacactgtggagttggtccgat

SEQ ID NO: 111067 - DNA, 25 bp, mus musculus
tacactgtggagttggtccgataga

SEQ ID NO: 111068 - DNA, 25 bp, mus musculus
agttctttggacgtgccacctcaca

SEQ ID NO: 111069 - DNA, 25 bp, mus musculus
tctttggacgtgccacctcacaacc

SEQ ID NO: 111070 - DNA, 25 bp, mus musculus
cctcacaaccagtgagactcgtagt

SEQ ID NO: 111071 - DNA, 25 bp, mus musculus
cacaaccagtgagactcgtagtcaa

SEQ ID NO: 111072 - DNA, 25 bp, mus musculus
gactcgtagtcaagcacgaatctga

SEQ ID NO: 111073 - DNA, 25 bp, mus musculus
tagtcaagcacgaatctgaagaagc

SEQ ID NO: 111074 - DNA, 25 bp, mus musculus
gcgcctggacctctagaccagcagg

SEQ ID NO: 111075 - DNA, 25 bp, mus musculus
cctggacctctagaccagcaggaca

SEQ ID NO: 111076 - DNA, 25 bp, mus musculus
caatctgagcccagtccccagctgg

SEQ ID NO: 111077 - DNA, 25 bp, mus musculus
gcttcacttccgtcactctggtgct

SEQ ID NO: 111078 - DNA, 25 bp, mus musculus
tcactctggtgctctcgcatcacag

SEQ ID NO: 111079 - DNA, 25 bp, mus musculus
tggtgctctcgcatcacagaagctt

SEQ ID NO: 111080 - DNA, 25 bp, mus musculus
cgcatcacagaagcttgcccccatg

SEQ ID NO: 111081 - DNA, 25 bp, mus musculus
atcacagaagcttgcccccatggct

SEQ ID NO: 111082 - DNA, 25 bp, mus musculus
acagaagcttgcccccatggctgcc

SEQ ID NO: 111083 - DNA, 25 bp, mus musculus
tccttggtcaacccaattaggctat

SEQ ID NO: 111084 - DNA, 25 bp, mus musculus
ttggtcaacccaattaggctatgct

SEQ ID NO: 111085 - DNA, 25 bp, mus musculus
gtcaacccaattaggctatgctaaa

SEQ ID NO: 111086 - DNA, 25 bp, mus musculus
ggacctctagaccagcaggacatgg

SEQ ID NO: 111087 - DNA, 25 bp, mus musculus
aacccaattaggctatgctaaacat

SEQ ID NO: 111088 - DNA, 25 bp, mus musculus
cctctagaccagcaggacatggtgt

SEQ ID NO: 111089 - DNA, 25 bp, mus musculus
gaagctcagggctgcagaatgagga

SEQ ID NO: 111090 - DNA, 25 bp, mus musculus
tctgcccttaacattcaggaccaat

SEQ ID NO: 111091 - DNA, 25 bp, mus musculus
gcccttaacattcaggaccaatctg

SEQ ID NO: 111092 - DNA, 25 bp, mus musculus
cttaacattcaggaccaatctgagc

SEQ ID NO: 111093 - DNA, 25 bp, mus musculus
aacattcaggaccaatctgagccca

SEQ ID NO: 111094 - DNA, 25 bp, mus musculus
attcaggaccaatctgagcccagtc

SEQ ID NO: 111095 - DNA, 25 bp, mus musculus
ccagctgatcgactccatggccaac

SEQ ID NO: 111096 - DNA, 25 bp, mus musculus
gctgatcgactccatggccaactcg

SEQ ID NO: 111097 - DNA, 25 bp, mus musculus
ctgtcgctggtggagctggccatcg

SEQ ID NO: 111098 - DNA, 25 bp, mus musculus
gagctggccatcgggaggtatccca

SEQ ID NO: 111099 - DNA, 25 bp, mus musculus
ccacctgatgccaaggaactagagg

SEQ ID NO: 111100 - DNA, 25 bp, mus musculus
gaactagaggccagctttggcggcc

SEQ ID NO: 111101 - DNA, 25 bp, mus musculus
ctagaggccagctttggcggcctgt

SEQ ID NO: 111102 - DNA, 25 bp, mus musculus
cagacggagaaccccatagtgtctc

SEQ ID NO: 111103 - DNA, 25 bp, mus musculus
gagaaccccatagtgtctccccgag

SEQ ID NO: 111104 - DNA, 25 bp, mus musculus
ggacgccccatcagtggtcatggga

SEQ ID NO: 111105 - DNA, 25 bp, mus musculus
gacgccccatcagtggtcatgggat

SEQ ID NO: 111106 - DNA, 25 bp, mus musculus
cgccccatcagtggtcatgggatgg

SEQ ID NO: 111107 - DNA, 25 bp, mus musculus
ctgatcgactccatggccaactcgt

SEQ ID NO: 111108 - DNA, 25 bp, mus musculus
atcgactccatggccaactcgtttg

SEQ ID NO: 111109 - DNA, 25 bp, mus musculus
cgactccatggccaactcgtttgta

SEQ ID NO: 111110 - DNA, 25 bp, mus musculus
gactccatggccaactcgtttgtag

SEQ ID NO: 111111 - DNA, 25 bp, mus musculus
ctccatggccaactcgtttgtaggg

SEQ ID NO: 111112 - DNA, 25 bp, mus musculus
tccatggccaactcgtttgtaggga

SEQ ID NO: 111113 - DNA, 25 bp, mus musculus
catggccaactcgtttgtagggacg

SEQ ID NO: 111114 - DNA, 25 bp, mus musculus
gccaactcgtttgtagggacgcgct

SEQ ID NO: 111115 - DNA, 25 bp, mus musculus
ctttctcatgactggctataccccc

SEQ ID NO: 111116 - DNA, 25 bp, mus musculus
caccacggaccagtcagtggccagt

SEQ ID NO: 111117 - DNA, 25 bp, mus musculus
gtccacaggccgggatcgtcagacc

SEQ ID NO: 111118 - DNA, 25 bp, mus musculus
cacaggccgggatcgtcagaccaac

SEQ ID NO: 111119 - DNA, 25 bp, mus musculus
ggatcgtcagaccaaccactgctac

SEQ ID NO: 111120 - DNA, 25 bp, mus musculus
tcgtcagaccaaccactgctacatc

SEQ ID NO: 111121 - DNA, 25 bp, mus musculus
cgccatcctcaacatcatccaggga

SEQ ID NO: 111122 - DNA, 25 bp, mus musculus
cacccaggtccacaagagcctgcag

SEQ ID NO: 111123 - DNA, 25 bp, mus musculus
ccaggtccacaagagcctgcagagg

SEQ ID NO: 111124 - DNA, 25 bp, mus musculus
ggtccacaagagcctgcagaggatc

SEQ ID NO: 111125 - DNA, 25 bp, mus musculus
ccacaagagcctgcagaggatccgg

SEQ ID NO: 111126 - DNA, 25 bp, mus musculus
gaaactggccaacttcatcccctgg

SEQ ID NO: 111127 - DNA, 25 bp, mus musculus
gaagacaacagtcctggatgtcatg

SEQ ID NO: 111128 - DNA, 25 bp, mus musculus
gggcccagccagcatccaggtggcc

SEQ ID NO: 111129 - DNA, 25 bp, mus musculus
gacaacagtcctggatgtcatgagg

SEQ ID NO: 111130 - DNA, 25 bp, mus musculus
aacagtcctggatgtcatgaggcgc

SEQ ID NO: 111131 - DNA, 25 bp, mus musculus
tgtcatgaggcgcctgctacagccc

SEQ ID NO: 111132 - DNA, 25 bp, mus musculus
gcgcctgctacagcccaagaatgtg

SEQ ID NO: 111133 - DNA, 25 bp, mus musculus
cctgctacagcccaagaatgtgatg

SEQ ID NO: 111134 - DNA, 25 bp, mus musculus
gctacagcccaagaatgtgatggtg

SEQ ID NO: 111135 - DNA, 25 bp, mus musculus
acagcccaagaatgtgatggtgtcc

SEQ ID NO: 111136 - DNA, 25 bp, mus musculus
cctccgtgctgaaggatgagactgt

SEQ ID NO: 111137 - DNA, 25 bp, mus musculus
tctcagtgcccaatggacagcccag

SEQ ID NO: 111138 - DNA, 25 bp, mus musculus
gacactaattccagtcatggtaggc

SEQ ID NO: 111139 - DNA, 25 bp, mus musculus
cactaattccagtcatggtaggcag

SEQ ID NO: 111140 - DNA, 25 bp, mus musculus
aattccagtcatggtaggcagggca

SEQ ID NO: 111141 - DNA, 25 bp, mus musculus
ccagtcatggtaggcagggcaggct

SEQ ID NO: 111142 - DNA, 25 bp, mus musculus
taaaccaatcttgtggctgctgctg

SEQ ID NO: 111143 - DNA, 25 bp, mus musculus
ccaatcttgtggctgctgctgtttt

SEQ ID NO: 111144 - DNA, 25 bp, mus musculus
tcttgtggctgctgctgttttctgc

SEQ ID NO: 111145 - DNA, 25 bp, mus musculus
ggctgctgctgttttctgcttcaat

SEQ ID NO: 111146 - DNA, 25 bp, mus musculus
ctgctgctgttttctgcttcaatcc

SEQ ID NO: 111147 - DNA, 25 bp, mus musculus
gctgctgttttctgcttcaatccca

SEQ ID NO: 111148 - DNA, 25 bp, mus musculus
tcagtgcccaatggacagcccaggc

SEQ ID NO: 111149 - DNA, 25 bp, mus musculus
gctgttttctgcttcaatcccagcc

SEQ ID NO: 111150 - DNA, 25 bp, mus musculus
tgcccaatggacagcccaggcctag

SEQ ID NO: 111151 - DNA, 25 bp, mus musculus
caatggacagcccaggcctagaaac

SEQ ID NO: 111152 - DNA, 25 bp, mus musculus
atggacagcccaggcctagaaacct

SEQ ID NO: 111153 - DNA, 25 bp, mus musculus
ggacagcccaggcctagaaaccttg

SEQ ID NO: 111154 - DNA, 25 bp, mus musculus
cagctctgtgctgtgatgcgtgagc

SEQ ID NO: 111155 - DNA, 25 bp, mus musculus
gctctgtgctgtgatgcgtgagcaa

SEQ ID NO: 111156 - DNA, 25 bp, mus musculus
aggacactaattccagtcatggtag

SEQ ID NO: 111157 - DNA, 25 bp, mus musculus
acttggtcaagatcgccacaaccag

SEQ ID NO: 111158 - DNA, 25 bp, mus musculus
tggtcaagatcgccacaaccagagc

SEQ ID NO: 111159 - DNA, 25 bp, mus musculus
ctaccagcacgacttggctctgctg

SEQ ID NO: 111160 - DNA, 25 bp, mus musculus
tctgctgcgcctgcaggaaagcaaa

SEQ ID NO: 111161 - DNA, 25 bp, mus musculus
aagcaaaaccaacagttgcgcgatc

SEQ ID NO: 111162 - DNA, 25 bp, mus musculus
aaccaacagttgcgcgatcctgtca

SEQ ID NO: 111163 - DNA, 25 bp, mus musculus
caacagttgcgcgatcctgtcacct

SEQ ID NO: 111164 - DNA, 25 bp, mus musculus
cagttgcgcgatcctgtcacctcac

SEQ ID NO: 111165 - DNA, 25 bp, mus musculus
ttgcgcgatcctgtcacctcacgtt

SEQ ID NO: 111166 - DNA, 25 bp, mus musculus
cgcgatcctgtcacctcacgttcag

SEQ ID NO: 111167 - DNA, 25 bp, mus musculus
gatcctgtcacctcacgttcagcct

SEQ ID NO: 111168 - DNA, 25 bp, mus musculus
cctgtcacctcacgttcagcctgtg

SEQ ID NO: 111169 - DNA, 25 bp, mus musculus
tcaagatcgccacaaccagagctgc

SEQ ID NO: 111170 - DNA, 25 bp, mus musculus
agatcgccacaaccagagctgcgag

SEQ ID NO: 111171 - DNA, 25 bp, mus musculus
tcgccacaaccagagctgcgagtgg

SEQ ID NO: 111172 - DNA, 25 bp, mus musculus
gagctgcgagtggtgccagactctg

SEQ ID NO: 111173 - DNA, 25 bp, mus musculus
gtgccagactctggctgtgcgctcc

SEQ ID NO: 111174 - DNA, 25 bp, mus musculus
ccagactctggctgtgcgctcctac

SEQ ID NO: 111175 - DNA, 25 bp, mus musculus
catcacctaccagcacgacttggct

SEQ ID NO: 111176 - DNA, 25 bp, mus musculus
cacctaccagcacgacttggctctg

SEQ ID NO: 111177 - DNA, 25 bp, mus musculus
tcgcccggaggctggacaaaatggt

SEQ ID NO: 111178 - DNA, 25 bp, mus musculus
agaatatgcctattacattgcactt

SEQ ID NO: 111179 - DNA, 25 bp, mus musculus
acttgctccagtccacccgtgttgg

SEQ ID NO: 111180 - DNA, 25 bp, mus musculus
tgctccagtccacccgtgttgggat

SEQ ID NO: 111181 - DNA, 25 bp, mus musculus
gctccagtccacccgtgttgggatg

SEQ ID NO: 111182 - DNA, 25 bp, mus musculus
ccagtccacccgtgttgggatgtct

SEQ ID NO: 111183 - DNA, 25 bp, mus musculus
agtccacccgtgttgggatgtctgt

SEQ ID NO: 111184 - DNA, 25 bp, mus musculus
ccacccgtgttgggatgtctgtcaa

SEQ ID NO: 111185 - DNA, 25 bp, mus musculus
cacccgtgttgggatgtctgtcaat

SEQ ID NO: 111186 - DNA, 25 bp, mus musculus
gatgtctgtcaatgctctgcgcaac

SEQ ID NO: 111187 - DNA, 25 bp, mus musculus
tgtctgtcaatgctctgcgcaacga

SEQ ID NO: 111188 - DNA, 25 bp, mus musculus
gtctgtcaatgctctgcgcaacgag

SEQ ID NO: 111189 - DNA, 25 bp, mus musculus
gaatatgcctattacattgcacttg

SEQ ID NO: 111190 - DNA, 25 bp, mus musculus
tatgcctattacattgcacttgctc

SEQ ID NO: 111191 - DNA, 25 bp, mus musculus
tgcctattacattgcacttgctcca

SEQ ID NO: 111192 - DNA, 25 bp, mus musculus
ctattacattgcacttgctccagtc

SEQ ID NO: 111193 - DNA, 25 bp, mus musculus
tattacattgcacttgctccagtcc

SEQ ID NO: 111194 - DNA, 25 bp, mus musculus
ttacattgcacttgctccagtccac

SEQ ID NO: 111195 - DNA, 25 bp, mus musculus
attgcacttgctccagtccacccgt

SEQ ID NO: 111196 - DNA, 25 bp, mus musculus
tgcacttgctccagtccacccgtgt

SEQ ID NO: 111197 - DNA, 25 bp, mus musculus
catctacctcagcctgttcccggaa

SEQ ID NO: 111198 - DNA, 25 bp, mus musculus
atctacctcagcctgttcccggaag

SEQ ID NO: 111199 - DNA, 25 bp, mus musculus
tgttcccggaagtgcatctgcttgt

SEQ ID NO: 111200 - DNA, 25 bp, mus musculus
gttcccggaagtgcatctgcttgtc

SEQ ID NO: 111201 - DNA, 25 bp, mus musculus
cccggaagtgcatctgcttgtctcg

SEQ ID NO: 111202 - DNA, 25 bp, mus musculus
atctgcttgtctcgggcgagatggc

SEQ ID NO: 111203 - DNA, 25 bp, mus musculus
tgcttgtctcgggcgagatggcttc

SEQ ID NO: 111204 - DNA, 25 bp, mus musculus
gcttgtctcgggcgagatggcttca

SEQ ID NO: 111205 - DNA, 25 bp, mus musculus
tctacctcagcctgttcccggaagt

SEQ ID NO: 111206 - DNA, 25 bp, mus musculus
ctacctcagcctgttcccggaagtg

SEQ ID NO: 111207 - DNA, 25 bp, mus musculus
tacctcagcctgttcccggaagtgc

SEQ ID NO: 111208 - DNA, 25 bp, mus musculus
acctcagcctgttcccggaagtgca

SEQ ID NO: 111209 - DNA, 25 bp, mus musculus
cctcagcctgttcccggaagtgcat

SEQ ID NO: 111210 - DNA, 25 bp, mus musculus
tcagcctgttcccggaagtgcatct

SEQ ID NO: 111211 - DNA, 25 bp, mus musculus
gcctgttcccggaagtgcatctgct

SEQ ID NO: 111212 - DNA, 25 bp, mus musculus
cctgttcccggaagtgcatctgctt

SEQ ID NO: 111213 - DNA, 25 bp, mus musculus
aggatcaccagtagtcgcttcaaga

SEQ ID NO: 111214 - DNA, 25 bp, mus musculus
accagtagtcgcttcaagacaaaga

SEQ ID NO: 111215 - DNA, 25 bp, mus musculus
gttgatcacggtcctaagggatagg

SEQ ID NO: 111216 - DNA, 25 bp, mus musculus
tgaaatggtcacgcctaaggaatgg

SEQ ID NO: 111217 - DNA, 25 bp, mus musculus
aatggtcacgcctaaggaatggtct

SEQ ID NO: 111218 - DNA, 25 bp, mus musculus
tttaattagccatgtactttggtgt

SEQ ID NO: 111219 - DNA, 25 bp, mus musculus
tagccatgtactttggtgtgatttg

SEQ ID NO: 111220 - DNA, 25 bp, mus musculus
aaagctctggagacctcatgtcact

SEQ ID NO: 111221 - DNA, 25 bp, mus musculus
gctctggagacctcatgtcacttta

SEQ ID NO: 111222 - DNA, 25 bp, mus musculus
ctggagacctcatgtcactttaacg

SEQ ID NO: 111223 - DNA, 25 bp, mus musculus
tcatgtcactttaacgttgtgttag

SEQ ID NO: 111224 - DNA, 25 bp, mus musculus
tttaacgttgtgttagctgcagaat

SEQ ID NO: 111225 - DNA, 25 bp, mus musculus
agtcgcttcaagacaaagaagggca

SEQ ID NO: 111226 - DNA, 25 bp, mus musculus
gaagtctgcgctgaagcccatcaga

SEQ ID NO: 111227 - DNA, 25 bp, mus musculus
gtctgcgctgaagcccatcagaagt

SEQ ID NO: 111228 - DNA, 25 bp, mus musculus
agaagcaaaattcctcaccgctgtt

SEQ ID NO: 111229 - DNA, 25 bp, mus musculus
agcaaaattcctcaccgctgttctt

SEQ ID NO: 111230 - DNA, 25 bp, mus musculus
cctcaccgctgttctttctgagaac

SEQ ID NO: 111231 - DNA, 25 bp, mus musculus
caccgctgttctttctgagaactgt

SEQ ID NO: 111232 - DNA, 25 bp, mus musculus
tgtgttgatcacggtcctaagggat

SEQ ID NO: 111233 - DNA, 25 bp, mus musculus
cgatggcccagcagcagatgaccag

SEQ ID NO: 111234 - DNA, 25 bp, mus musculus
atggcccagcagcagatgaccagct

SEQ ID NO: 111235 - DNA, 25 bp, mus musculus
ccctgatgcttgagctgaaatccct

SEQ ID NO: 111236 - DNA, 25 bp, mus musculus
tgagctgaaatccctgcaggaggaa

SEQ ID NO: 111237 - DNA, 25 bp, mus musculus
ggcttccggatcaccctggtggatg

SEQ ID NO: 111238 - DNA, 25 bp, mus musculus
gatcaccctggtggatgagtccgac

SEQ ID NO: 111239 - DNA, 25 bp, mus musculus
tcaccctggtggatgagtccgacct

SEQ ID NO: 111240 - DNA, 25 bp, mus musculus
accctggtggatgagtccgacctct

SEQ ID NO: 111241 - DNA, 25 bp, mus musculus
atgagtccgacctctacaactggga

SEQ ID NO: 111242 - DNA, 25 bp, mus musculus
cggctacttcaaggcacatattaag

SEQ ID NO: 111243 - DNA, 25 bp, mus musculus
gctacttcaaggcacatattaagtt

SEQ ID NO: 111244 - DNA, 25 bp, mus musculus
tacttcaaggcacatattaagtttc

SEQ ID NO: 111245 - DNA, 25 bp, mus musculus
cccagcagcagatgaccagctcgca

SEQ ID NO: 111246 - DNA, 25 bp, mus musculus
agcagatgaccagctcgcagaaagc

SEQ ID NO: 111247 - DNA, 25 bp, mus musculus
gatgaccagctcgcagaaagccctg

SEQ ID NO: 111248 - DNA, 25 bp, mus musculus
accagctcgcagaaagccctgatgc

SEQ ID NO: 111249 - DNA, 25 bp, mus musculus
cagctcgcagaaagccctgatgctt

SEQ ID NO: 111250 - DNA, 25 bp, mus musculus
tcgcagaaagccctgatgcttgagc

SEQ ID NO: 111251 - DNA, 25 bp, mus musculus
gcagaaagccctgatgcttgagctg

SEQ ID NO: 111252 - DNA, 25 bp, mus musculus
aaagccctgatgcttgagctgaaat

SEQ ID NO: 111253 - DNA, 25 bp, mus musculus
tgtcatcacactccttaacactgtg

SEQ ID NO: 111254 - DNA, 25 bp, mus musculus
cacactccttaacactgtgcactac

SEQ ID NO: 111255 - DNA, 25 bp, mus musculus
tatgcacattcgctgagtactgcgc

SEQ ID NO: 111256 - DNA, 25 bp, mus musculus
cattcgctgagtactgcgcccaggg

SEQ ID NO: 111257 - DNA, 25 bp, mus musculus
ggttcactgtcataggcctccattg

SEQ ID NO: 111258 - DNA, 25 bp, mus musculus
ctgtcataggcctccattgatatct

SEQ ID NO: 111259 - DNA, 25 bp, mus musculus
gatatctctctcacatgatcttccc

SEQ ID NO: 111260 - DNA, 25 bp, mus musculus
tctctcacatgatcttcccttaacc

SEQ ID NO: 111261 - DNA, 25 bp, mus musculus
agcccatcttcatggaaagaatgac

SEQ ID NO: 111262 - DNA, 25 bp, mus musculus
ttatacgcacagaacctattctatg

SEQ ID NO: 111263 - DNA, 25 bp, mus musculus
gcacagaacctattctatgatgcac

SEQ ID NO: 111264 - DNA, 25 bp, mus musculus
ttctatgatgcacccttttcctgtc

SEQ ID NO: 111265 - DNA, 25 bp, mus musculus
cactgtgcactacgactcggaccag

SEQ ID NO: 111266 - DNA, 25 bp, mus musculus
gacgcctcaggagttcaatcctgaa

SEQ ID NO: 111267 - DNA, 25 bp, mus musculus
ttcggctggacgtcgactgtgtctg

SEQ ID NO: 111268 - DNA, 25 bp, mus musculus
gctcttcatatacttcacctccatt

SEQ ID NO: 111269 - DNA, 25 bp, mus musculus
tctgcagaacttcacattgcagccg

SEQ ID NO: 111270 - DNA, 25 bp, mus musculus
gaacttcacattgcagccgctggtg

SEQ ID NO: 111271 - DNA, 25 bp, mus musculus
cacattgcagccgctggtggatcct

SEQ ID NO: 111272 - DNA, 25 bp, mus musculus
tttccagctgtgtatgcacattcgc

SEQ ID NO: 111273 - DNA, 25 bp, mus musculus
cggcatcacctctgttgcatacacg

SEQ ID NO: 111274 - DNA, 25 bp, mus musculus
gcatcacctctgttgcatacacgcg

SEQ ID NO: 111275 - DNA, 25 bp, mus musculus
tatcctcgctggccaagatatacgt

SEQ ID NO: 111276 - DNA, 25 bp, mus musculus
tacgtgtgagttgcctctgggtaag

SEQ ID NO: 111277 - DNA, 25 bp, mus musculus
ttgcctctgggtaagatatgacgga

SEQ ID NO: 111278 - DNA, 25 bp, mus musculus
gctacaggttcctggtgcatctacc

SEQ ID NO: 111279 - DNA, 25 bp, mus musculus
tacaggttcctggtgcatctacctc

SEQ ID NO: 111280 - DNA, 25 bp, mus musculus
caggttcctggtgcatctacctcaa

SEQ ID NO: 111281 - DNA, 25 bp, mus musculus
ggttcctggtgcatctacctcaaga

SEQ ID NO: 111282 - DNA, 25 bp, mus musculus
tggtgcatctacctcaagatcctgg

SEQ ID NO: 111283 - DNA, 25 bp, mus musculus
gtgcatctacctcaagatcctggac

SEQ ID NO: 111284 - DNA, 25 bp, mus musculus
gcatctacctcaagatcctggacta

SEQ ID NO: 111285 - DNA, 25 bp, mus musculus
tgttgcatacacgcgcagaccgagc

SEQ ID NO: 111286 - DNA, 25 bp, mus musculus
atctacctcaagatcctggactaat

SEQ ID NO: 111287 - DNA, 25 bp, mus musculus
ttgcatacacgcgcagaccgagctg

SEQ ID NO: 111288 - DNA, 25 bp, mus musculus
atacacgcgcagaccgagctgctgc

SEQ ID NO: 111289 - DNA, 25 bp, mus musculus
acacgcgcagaccgagctgctgctc

SEQ ID NO: 111290 - DNA, 25 bp, mus musculus
acgcgcagaccgagctgctgctcga

SEQ ID NO: 111291 - DNA, 25 bp, mus musculus
agaccgagctgctgctcgatggcta

SEQ ID NO: 111292 - DNA, 25 bp, mus musculus
accgagctgctgctcgatggctacg

SEQ ID NO: 111293 - DNA, 25 bp, mus musculus
ggtatcctcgctggccaagatatac

SEQ ID NO: 111294 - DNA, 25 bp, mus musculus
actcagaccctgctgcggaagaagg

SEQ ID NO: 111295 - DNA, 25 bp, mus musculus
cagaccctgctgcggaagaaggaga

SEQ ID NO: 111296 - DNA, 25 bp, mus musculus
aagcagcgcctgaacagccagtcca

SEQ ID NO: 111297 - DNA, 25 bp, mus musculus
cagcgcctgaacagccagtccaagc

SEQ ID NO: 111298 - DNA, 25 bp, mus musculus
ctgaacagccagtccaagcgcacaa

SEQ ID NO: 111299 - DNA, 25 bp, mus musculus
aacagccagtccaagcgcacaatcg

SEQ ID NO: 111300 - DNA, 25 bp, mus musculus
agccagtccaagcgcacaatcgagg

SEQ ID NO: 111301 - DNA, 25 bp, mus musculus
tccaagcgcacaatcgaggggctcc

SEQ ID NO: 111302 - DNA, 25 bp, mus musculus
aagcgcacaatcgaggggctccggg

SEQ ID NO: 111303 - DNA, 25 bp, mus musculus
ccgtcaggcatcgctaccctggtct

SEQ ID NO: 111304 - DNA, 25 bp, mus musculus
tcaggcatcgctaccctggtctctg

SEQ ID NO: 111305 - DNA, 25 bp, mus musculus
ggcatcgctaccctggtctctggca

SEQ ID NO: 111306 - DNA, 25 bp, mus musculus
accctgctgcggaagaaggagaaag

SEQ ID NO: 111307 - DNA, 25 bp, mus musculus
acaatggacgcactccaggctgaca

SEQ ID NO: 111308 - DNA, 25 bp, mus musculus
gacgcactccaggctgacatcgacc

SEQ ID NO: 111309 - DNA, 25 bp, mus musculus
gcactccaggctgacatcgaccagc

SEQ ID NO: 111310 - DNA, 25 bp, mus musculus
gctgacatcgaccagctggaggcag

SEQ ID NO: 111311 - DNA, 25 bp, mus musculus
gacatcgaccagctggaggcagaga

SEQ ID NO: 111312 - DNA, 25 bp, mus musculus
atcgaccagctggaggcagagaagg

SEQ ID NO: 111313 - DNA, 25 bp, mus musculus
ctcaagcagcgcctgaacagccagt

SEQ ID NO: 111314 - DNA, 25 bp, mus musculus
gaaatgctgggagccgcttggcctg

SEQ ID NO: 111315 - DNA, 25 bp, mus musculus
tgcgcagtaaacattccctgtgtgg

SEQ ID NO: 111316 - DNA, 25 bp, mus musculus
agactcaactgctaccctcaaacca

SEQ ID NO: 111317 - DNA, 25 bp, mus musculus
actcaactgctaccctcaaaccatt

SEQ ID NO: 111318 - DNA, 25 bp, mus musculus
ctcaaaccattaaactgtaatctga

SEQ ID NO: 111319 - DNA, 25 bp, mus musculus
tgtaactgtgtgactcctttgactg

SEQ ID NO: 111320 - DNA, 25 bp, mus musculus
actgtgtgactcctttgactgggct

SEQ ID NO: 111321 - DNA, 25 bp, mus musculus
tgtgtgactcctttgactgggctaa

SEQ ID NO: 111322 - DNA, 25 bp, mus musculus
tgtgactcctttgactgggctaagg

SEQ ID NO: 111323 - DNA, 25 bp, mus musculus
tgactcctttgactgggctaaggac

SEQ ID NO: 111324 - DNA, 25 bp, mus musculus
tcctttgactgggctaaggacagca

SEQ ID NO: 111325 - DNA, 25 bp, mus musculus
ctttgactgggctaaggacagcaat

SEQ ID NO: 111326 - DNA, 25 bp, mus musculus
cgcagtaaacattccctgtgtggtc

SEQ ID NO: 111327 - DNA, 25 bp, mus musculus
agactgtgtacaactcactgaattc

SEQ ID NO: 111328 - DNA, 25 bp, mus musculus
gtaaacattccctgtgtggtctgaa

SEQ ID NO: 111329 - DNA, 25 bp, mus musculus
acattccctgtgtggtctgaagtct

SEQ ID NO: 111330 - DNA, 25 bp, mus musculus
attccctgtgtggtctgaagtctca

SEQ ID NO: 111331 - DNA, 25 bp, mus musculus
ctgaagtctcagactcaactgctac

SEQ ID NO: 111332 - DNA, 25 bp, mus musculus
gaagtctcagactcaactgctaccc

SEQ ID NO: 111333 - DNA, 25 bp, mus musculus
agtctcagactcaactgctaccctc

SEQ ID NO: 111334 - DNA, 25 bp, mus musculus
tctcagactcaactgctaccctcaa

SEQ ID NO: 111335 - DNA, 25 bp, mus musculus
agtacccagaccgcatcatgaacac

SEQ ID NO: 111336 - DNA, 25 bp, mus musculus
tacccagaccgcatcatgaacacct

SEQ ID NO: 111337 - DNA, 25 bp, mus musculus
gatgaaacctattccattgacaatg

SEQ ID NO: 111338 - DNA, 25 bp, mus musculus
atgaaacctattccattgacaatga

SEQ ID NO: 111339 - DNA, 25 bp, mus musculus
tgaaacctattccattgacaatgag

SEQ ID NO: 111340 - DNA, 25 bp, mus musculus
aaacctattccattgacaatgaggc

SEQ ID NO: 111341 - DNA, 25 bp, mus musculus
aacctattccattgacaatgaggct

SEQ ID NO: 111342 - DNA, 25 bp, mus musculus
acctattccattgacaatgaggctc

SEQ ID NO: 111343 - DNA, 25 bp, mus musculus
cctattccattgacaatgaggctct

SEQ ID NO: 111344 - DNA, 25 bp, mus musculus
tattccattgacaatgaggctctgt

SEQ ID NO: 111345 - DNA, 25 bp, mus musculus
attccattgacaatgaggctctgta

SEQ ID NO: 111346 - DNA, 25 bp, mus musculus
gctctgtatgacatctgtttccgca

SEQ ID NO: 111347 - DNA, 25 bp, mus musculus
acccagaccgcatcatgaacacctt

SEQ ID NO: 111348 - DNA, 25 bp, mus musculus
ccagaccgcatcatgaacaccttca

SEQ ID NO: 111349 - DNA, 25 bp, mus musculus
agaccgcatcatgaacaccttcagc

SEQ ID NO: 111350 - DNA, 25 bp, mus musculus
caccctctcagtgcaccagctggta

SEQ ID NO: 111351 - DNA, 25 bp, mus musculus
accctctcagtgcaccagctggtag

SEQ ID NO: 111352 - DNA, 25 bp, mus musculus
ctcagtgcaccagctggtagagaac

SEQ ID NO: 111353 - DNA, 25 bp, mus musculus
acagatgaaacctattccattgaca

SEQ ID NO: 111354 - DNA, 25 bp, mus musculus
agatgaaacctattccattgacaat

SEQ ID NO: 111355 - DNA, 25 bp, mus musculus
ttctcaccacctttctaactactca

SEQ ID NO: 111356 - DNA, 25 bp, mus musculus
tcaccacctttctaactactcagct

SEQ ID NO: 111357 - DNA, 25 bp, mus musculus
tgtaatcccagtcatagtggaggct

SEQ ID NO: 111358 - DNA, 25 bp, mus musculus
aatcccagtcatagtggaggctgag

SEQ ID NO: 111359 - DNA, 25 bp, mus musculus
cccagtcatagtggaggctgaggct

SEQ ID NO: 111360 - DNA, 25 bp, mus musculus
attaaggaccaacagcctgggcaat

SEQ ID NO: 111361 - DNA, 25 bp, mus musculus
gaccaacagcctgggcaatttagtg

SEQ ID NO: 111362 - DNA, 25 bp, mus musculus
caacagcctgggcaatttagtgtct

SEQ ID NO: 111363 - DNA, 25 bp, mus musculus
gtatccctgtggggctgtggacagt

SEQ ID NO: 111364 - DNA, 25 bp, mus musculus
tgaaaccgagtaagcctttgtgtca

SEQ ID NO: 111365 - DNA, 25 bp, mus musculus
gtaagcctttgtgtcaagaagtggg

SEQ ID NO: 111366 - DNA, 25 bp, mus musculus
agcctttgtgtcaagaagtgggagt

SEQ ID NO: 111367 - DNA, 25 bp, mus musculus
ttctaactactcagctaaactcgtt

SEQ ID NO: 111368 - DNA, 25 bp, mus musculus
taactactcagctaaactcgttgag

SEQ ID NO: 111369 - DNA, 25 bp, mus musculus
ctactcagctaaactcgttgaggct

SEQ ID NO: 111370 - DNA, 25 bp, mus musculus
actcgttgaggctagggccaacgtg

SEQ ID NO: 111371 - DNA, 25 bp, mus musculus
ggccaacgtgacttctctgtagaga

SEQ ID NO: 111372 - DNA, 25 bp, mus musculus
caacgtgacttctctgtagagagga

SEQ ID NO: 111373 - DNA, 25 bp, mus musculus
gcaggcctgtgtaatcccagtcata

SEQ ID NO: 111374 - DNA, 25 bp, mus musculus
ctgtgtaatcccagtcatagtggag

SEQ ID NO: 111375 - DNA, 25 bp, mus musculus
ggggccccagtcaacgtctcctcat

SEQ ID NO: 111376 - DNA, 25 bp, mus musculus
ccagtcaacgtctcctcatctgatc

SEQ ID NO: 111377 - DNA, 25 bp, mus musculus
gacaagatacctctcgcatgtccac

SEQ ID NO: 111378 - DNA, 25 bp, mus musculus
caagatacctctcgcatgtccacct

SEQ ID NO: 111379 - DNA, 25 bp, mus musculus
ctctcgcatgtccacctcacagatt

SEQ ID NO: 111380 - DNA, 25 bp, mus musculus
catgtccacctcacagattcccggt

SEQ ID NO: 111381 - DNA, 25 bp, mus musculus
tcacagattcccggtcgggtggctt

SEQ ID NO: 111382 - DNA, 25 bp, mus musculus
gggtggcttccagtggtcttcagtc

SEQ ID NO: 111383 - DNA, 25 bp, mus musculus
tccagtggtcttcagtctgtcgtgc

SEQ ID NO: 111384 - DNA, 25 bp, mus musculus
cagtggtcttcagtctgtcgtgcac

SEQ ID NO: 111385 - DNA, 25 bp, mus musculus
ggtcttcagtctgtcgtgcaccgat

SEQ ID NO: 111386 - DNA, 25 bp, mus musculus
tcttcagtctgtcgtgcaccgatga

SEQ ID NO: 111387 - DNA, 25 bp, mus musculus
tctcctcatctgatctcacgggccg

SEQ ID NO: 111388 - DNA, 25 bp, mus musculus
gtctgtcgtgcaccgatgagaactc

SEQ ID NO: 111389 - DNA, 25 bp, mus musculus
ctcatctgatctcacgggccgacaa

SEQ ID NO: 111390 - DNA, 25 bp, mus musculus
catctgatctcacgggccgacaaga

SEQ ID NO: 111391 - DNA, 25 bp, mus musculus
tgatctcacgggccgacaagatacc

SEQ ID NO: 111392 - DNA, 25 bp, mus musculus
atctcacgggccgacaagatacctc

SEQ ID NO: 111393 - DNA, 25 bp, mus musculus
ctcacgggccgacaagatacctctc

SEQ ID NO: 111394 - DNA, 25 bp, mus musculus
ggccgacaagatacctctcgcatgt

SEQ ID NO: 111395 - DNA, 25 bp, mus musculus
ccgacaagatacctctcgcatgtcc

SEQ ID NO: 111396 - DNA, 25 bp, mus musculus
tgataactttgcttgcggtagattt

SEQ ID NO: 111397 - DNA, 25 bp, mus musculus
agttacatgcatacttcaaaagtat

SEQ ID NO: 111398 - DNA, 25 bp, mus musculus
tgtacatccgtgtaacaggaagggc

SEQ ID NO: 111399 - DNA, 25 bp, mus musculus
gagctctgtaagcacagccttattt

SEQ ID NO: 111400 - DNA, 25 bp, mus musculus
tgtaagcacagccttattttcttct

SEQ ID NO: 111401 - DNA, 25 bp, mus musculus
aagcacagccttattttcttctgtt

SEQ ID NO: 111402 - DNA, 25 bp, mus musculus
cacagccttattttcttctgttgtc

SEQ ID NO: 111403 - DNA, 25 bp, mus musculus
attttcttctgttgtccagaatact

SEQ ID NO: 111404 - DNA, 25 bp, mus musculus
ttcttctgttgtccagaatacttag

SEQ ID NO: 111405 - DNA, 25 bp, mus musculus
ttagaattcttgagcctcccagaaa

SEQ ID NO: 111406 - DNA, 25 bp, mus musculus
gaattcttgagcctcccagaaattg

SEQ ID NO: 111407 - DNA, 25 bp, mus musculus
agcctcccagaaattggaagcaaat

SEQ ID NO: 111408 - DNA, 25 bp, mus musculus
agtgtaatttctttgcctgttcagt

SEQ ID NO: 111409 - DNA, 25 bp, mus musculus
atttctttgcctgttcagttacaga

SEQ ID NO: 111410 - DNA, 25 bp, mus musculus
ttgcctgttcagttacagaaagtgg

SEQ ID NO: 111411 - DNA, 25 bp, mus musculus
aaagtggtgctcagttgtagaatgt

SEQ ID NO: 111412 - DNA, 25 bp, mus musculus
tattgtaccttttaacatctgatgt

SEQ ID NO: 111413 - DNA, 25 bp, mus musculus
tgtaccttttaacatctgatgtgta

SEQ ID NO: 111414 - DNA, 25 bp, mus musculus
accttttaacatctgatgtgtacat

SEQ ID NO: 111415 - DNA, 25 bp, mus musculus
ctgatgtgtacatccgtgtaacagg

SEQ ID NO: 111416 - DNA, 25 bp, mus musculus
ccggactgcagcatgtgctccagac

SEQ ID NO: 111417 - DNA, 25 bp, mus musculus
tgcagcatgtgctccagacccaagg

SEQ ID NO: 111418 - DNA, 25 bp, mus musculus
attgtgaccatcctactgcagagtg

SEQ ID NO: 111419 - DNA, 25 bp, mus musculus
gtgaccatcctactgcagagtgacc

SEQ ID NO: 111420 - DNA, 25 bp, mus musculus
ctactgcagagtgaccaggagccac

SEQ ID NO: 111421 - DNA, 25 bp, mus musculus
agtgaccaggagccactgtaccaag

SEQ ID NO: 111422 - DNA, 25 bp, mus musculus
caggagccactgtaccaagtgcagc

SEQ ID NO: 111423 - DNA, 25 bp, mus musculus
ccactgtaccaagtgcagctcagtc

SEQ ID NO: 111424 - DNA, 25 bp, mus musculus
gtgcagctcagtccaggggactcac

SEQ ID NO: 111425 - DNA, 25 bp, mus musculus
ctcagtccaggggactcacggcttg

SEQ ID NO: 111426 - DNA, 25 bp, mus musculus
gactcacggcttgcggtgtttgaca

SEQ ID NO: 111427 - DNA, 25 bp, mus musculus
tcctcacgctccaatgccagtgtgg

SEQ ID NO: 111428 - DNA, 25 bp, mus musculus
agcatgtgctccagacccaaggtgg

SEQ ID NO: 111429 - DNA, 25 bp, mus musculus
tccagacccaaggtggcagctctca

SEQ ID NO: 111430 - DNA, 25 bp, mus musculus
agacccaaggtggcagctctcattg

SEQ ID NO: 111431 - DNA, 25 bp, mus musculus
gtggcagctctcattgtgggtaccc

SEQ ID NO: 111432 - DNA, 25 bp, mus musculus
ctgctgttcctgacaggcattgggg

SEQ ID NO: 111433 - DNA, 25 bp, mus musculus
ttcctgacaggcattggggccgcgt

SEQ ID NO: 111434 - DNA, 25 bp, mus musculus
tcctgggccattgtgaccatcctac

SEQ ID NO: 111435 - DNA, 25 bp, mus musculus
gccattgtgaccatcctactgcaga

SEQ ID NO: 111436 - DNA, 25 bp, mus musculus
tatgtcatctgcataaggtctcagt

SEQ ID NO: 111437 - DNA, 25 bp, mus musculus
atctgcataaggtctcagtgtcccc

SEQ ID NO: 111438 - DNA, 25 bp, mus musculus
gcacatcaacaacttgcagcaaagc

SEQ ID NO: 111439 - DNA, 25 bp, mus musculus
catcaacaacttgcagcaaagctct

SEQ ID NO: 111440 - DNA, 25 bp, mus musculus
caacttgcagcaaagctctgctcac

SEQ ID NO: 111441 - DNA, 25 bp, mus musculus
gcagcaaagctctgctcactcagac

SEQ ID NO: 111442 - DNA, 25 bp, mus musculus
agaactccattgtgttccatggaga

SEQ ID NO: 111443 - DNA, 25 bp, mus musculus
actccattgtgttccatggagacga

SEQ ID NO: 111444 - DNA, 25 bp, mus musculus
ccattgtgttccatggagacgagag

SEQ ID NO: 111445 - DNA, 25 bp, mus musculus
tccatggagacgagagcaggtggaa

SEQ ID NO: 111446 - DNA, 25 bp, mus musculus
gaaattgtctgcttctcatcttcag

SEQ ID NO: 111447 - DNA, 25 bp, mus musculus
tcatcttcagtgagattccaaagga

SEQ ID NO: 111448 - DNA, 25 bp, mus musculus
ccatgaggaacctcaagtggctccc

SEQ ID NO: 111449 - DNA, 25 bp, mus musculus
acctcaagtggctccccagcatatg

SEQ ID NO: 111450 - DNA, 25 bp, mus musculus
tcaagtggctccccagcatatgcac

SEQ ID NO: 111451 - DNA, 25 bp, mus musculus
agtggctccccagcatatgcacagg

SEQ ID NO: 111452 - DNA, 25 bp, mus musculus
tccccagcatatgcacagggtactg

SEQ ID NO: 111453 - DNA, 25 bp, mus musculus
gcatatgcacagggtactgtgtgta

SEQ ID NO: 111454 - DNA, 25 bp, mus musculus
tagagcccctagagcatgagcagat

SEQ ID NO: 111455 - DNA, 25 bp, mus musculus
tatgcacatcaacaacttgcagcaa

SEQ ID NO: 111456 - DNA, 25 bp, mus musculus
aaattcaagtccagtcaatccagtg

SEQ ID NO: 111457 - DNA, 25 bp, mus musculus
ttcaagtccagtcaatccagtggtc

SEQ ID NO: 111458 - DNA, 25 bp, mus musculus
ctttaggcaattctgcaccggagag

SEQ ID NO: 111459 - DNA, 25 bp, mus musculus
taggcaattctgcaccggagagttc

SEQ ID NO: 111460 - DNA, 25 bp, mus musculus
gcaattctgcaccggagagttcaga

SEQ ID NO: 111461 - DNA, 25 bp, mus musculus
agatggcgttccgataggatacaaa

SEQ ID NO: 111462 - DNA, 25 bp, mus musculus
aagcaccttccacagggtcataaag

SEQ ID NO: 111463 - DNA, 25 bp, mus musculus
caccttccacagggtcataaaggat

SEQ ID NO: 111464 - DNA, 25 bp, mus musculus
taatggcgatggcactggagtcgcc

SEQ ID NO: 111465 - DNA, 25 bp, mus musculus
cgatggcactggagtcgccagtatt

SEQ ID NO: 111466 - DNA, 25 bp, mus musculus
tggcactggagtcgccagtatttac

SEQ ID NO: 111467 - DNA, 25 bp, mus musculus
cactggagtcgccagtatttaccgg

SEQ ID NO: 111468 - DNA, 25 bp, mus musculus
tccagtcaatccagtggtcttcttc

SEQ ID NO: 111469 - DNA, 25 bp, mus musculus
caatccagtggtcttcttcgatgtc

SEQ ID NO: 111470 - DNA, 25 bp, mus musculus
ggtcttcttcgatgtcagcattggc

SEQ ID NO: 111471 - DNA, 25 bp, mus musculus
cttcttcgatgtcagcattggcggc

SEQ ID NO: 111472 - DNA, 25 bp, mus musculus
cgatgtcagcattggcggccaggaa

SEQ ID NO: 111473 - DNA, 25 bp, mus musculus
cagcattggcggccaggaagttggt

SEQ ID NO: 111474 - DNA, 25 bp, mus musculus
gctctttgcagacgtggtgcctaag

SEQ ID NO: 111475 - DNA, 25 bp, mus musculus
agacgtggtgcctaagacggcagag

SEQ ID NO: 111476 - DNA, 25 bp, mus musculus
atgagagctactcttaccaataaac

SEQ ID NO: 111477 - DNA, 25 bp, mus musculus
gctactcttaccaataaacagagcc

SEQ ID NO: 111478 - DNA, 25 bp, mus musculus
ggagtctgctgtgctgcttttcatt

SEQ ID NO: 111479 - DNA, 25 bp, mus musculus
gtctgctgtgctgcttttcattagc

SEQ ID NO: 111480 - DNA, 25 bp, mus musculus
gctgcttttcattagctgagtgcaa

SEQ ID NO: 111481 - DNA, 25 bp, mus musculus
gcttttcattagctgagtgcaatga

SEQ ID NO: 111482 - DNA, 25 bp, mus musculus
atgaacagatcctgcaaggagagaa

SEQ ID NO: 111483 - DNA, 25 bp, mus musculus
gggttctgctttcaaactgtagttg

SEQ ID NO: 111484 - DNA, 25 bp, mus musculus
ttctgctttcaaactgtagttggag

SEQ ID NO: 111485 - DNA, 25 bp, mus musculus
gttggagactcactctcatccccac

SEQ ID NO: 111486 - DNA, 25 bp, mus musculus
caactgctaccttctagaattctga

SEQ ID NO: 111487 - DNA, 25 bp, mus musculus
ctaccttctagaattctgatatttg

SEQ ID NO: 111488 - DNA, 25 bp, mus musculus
ccttcctggctctcaatcctgctgg

SEQ ID NO: 111489 - DNA, 25 bp, mus musculus
tggctctcaatcctgctgggagcta

SEQ ID NO: 111490 - DNA, 25 bp, mus musculus
tcaatcctgctgggagctaccaatg

SEQ ID NO: 111491 - DNA, 25 bp, mus musculus
accaatgcattggctgaggtctgag

SEQ ID NO: 111492 - DNA, 25 bp, mus musculus
aatgcattggctgaggtctgagtgt

SEQ ID NO: 111493 - DNA, 25 bp, mus musculus
gcattggctgaggtctgagtgtttg

SEQ ID NO: 111494 - DNA, 25 bp, mus musculus
accttgcatccaacccgaatatgta

SEQ ID NO: 111495 - DNA, 25 bp, mus musculus
catccaacccgaatatgtagggatg

SEQ ID NO: 111496 - DNA, 25 bp, mus musculus
aatcagcaggctaacaggcagttag

SEQ ID NO: 111497 - DNA, 25 bp, mus musculus
cagttagatcaggcggtgtgcgcct

SEQ ID NO: 111498 - DNA, 25 bp, mus musculus
ctgcacaaaagcctgtagaaccccg

SEQ ID NO: 111499 - DNA, 25 bp, mus musculus
ctaaatctggggctatttgaaagca

SEQ ID NO: 111500 - DNA, 25 bp, mus musculus
agcaagaacaaaccactgtctctgc

SEQ ID NO: 111501 - DNA, 25 bp, mus musculus
ctgtctctgcttctgcttctgaaac

SEQ ID NO: 111502 - DNA, 25 bp, mus musculus
ctgcttctgcttctgaaacgagaat

SEQ ID NO: 111503 - DNA, 25 bp, mus musculus
tcggtaactgcatttttctgtccca

SEQ ID NO: 111504 - DNA, 25 bp, mus musculus
gtaactgcatttttctgtcccacga

SEQ ID NO: 111505 - DNA, 25 bp, mus musculus
actgcatttttctgtcccacgagat

SEQ ID NO: 111506 - DNA, 25 bp, mus musculus
ttctgtcccacgagatatgcaaaag

SEQ ID NO: 111507 - DNA, 25 bp, mus musculus
tgtcccacgagatatgcaaaagcaa

SEQ ID NO: 111508 - DNA, 25 bp, mus musculus
attgagctgggctcctttctgtgct

SEQ ID NO: 111509 - DNA, 25 bp, mus musculus
tttctgtgctgggcatatggactgg

SEQ ID NO: 111510 - DNA, 25 bp, mus musculus
ggcatctttgtgtcacacttgtgtc

SEQ ID NO: 111511 - DNA, 25 bp, mus musculus
atctttgtgtcacacttgtgtccat

SEQ ID NO: 111512 - DNA, 25 bp, mus musculus
cacttgtgtccatagtatgtgcgta

SEQ ID NO: 111513 - DNA, 25 bp, mus musculus
ttgtgtccatagtatgtgcgtatgt

SEQ ID NO: 111514 - DNA, 25 bp, mus musculus
cgtatgtgcacccacgtggtatgtg

SEQ ID NO: 111515 - DNA, 25 bp, mus musculus
tgcacccacgtggtatgtgtgcgcc

SEQ ID NO: 111516 - DNA, 25 bp, mus musculus
accaatcttctgtcccggttcatgc

SEQ ID NO: 111517 - DNA, 25 bp, mus musculus
ccaatcttctgtcccggttcatgcg

SEQ ID NO: 111518 - DNA, 25 bp, mus musculus
cccggttcatgcgcaatgagttcag

SEQ ID NO: 111519 - DNA, 25 bp, mus musculus
ccggttcatgcgcaatgagttcagc

SEQ ID NO: 111520 - DNA, 25 bp, mus musculus
ttcagctattatagtcgcagtacca

SEQ ID NO: 111521 - DNA, 25 bp, mus musculus
ctattatagtcgcagtaccattgga

SEQ ID NO: 111522 - DNA, 25 bp, mus musculus
attatagtcgcagtaccattggagt

SEQ ID NO: 111523 - DNA, 25 bp, mus musculus
ttatagtcgcagtaccattggagtt

SEQ ID NO: 111524 - DNA, 25 bp, mus musculus
tatagtcgcagtaccattggagttg

SEQ ID NO: 111525 - DNA, 25 bp, mus musculus
tagtcgcagtaccattggagttgag

SEQ ID NO: 111526 - DNA, 25 bp, mus musculus
agtcgcagtaccattggagttgagt

SEQ ID NO: 111527 - DNA, 25 bp, mus musculus
gtcgcagtaccattggagttgagtt

SEQ ID NO: 111528 - DNA, 25 bp, mus musculus
caatcttctgtcccggttcatgcgc

SEQ ID NO: 111529 - DNA, 25 bp, mus musculus
tcgcagtaccattggagttgagttc

SEQ ID NO: 111530 - DNA, 25 bp, mus musculus
atcttctgtcccggttcatgcgcaa

SEQ ID NO: 111531 - DNA, 25 bp, mus musculus
tcttctgtcccggttcatgcgcaat

SEQ ID NO: 111532 - DNA, 25 bp, mus musculus
cttctgtcccggttcatgcgcaatg

SEQ ID NO: 111533 - DNA, 25 bp, mus musculus
tctgtcccggttcatgcgcaatgag

SEQ ID NO: 111534 - DNA, 25 bp, mus musculus
ctgtcccggttcatgcgcaatgagt

SEQ ID NO: 111535 - DNA, 25 bp, mus musculus
tgtcccggttcatgcgcaatgagtt

SEQ ID NO: 111536 - DNA, 25 bp, mus musculus
tcccggttcatgcgcaatgagttca

SEQ ID NO: 111537 - DNA, 25 bp, mus musculus
actttcactgctgaatatgtggagt

SEQ ID NO: 111538 - DNA, 25 bp, mus musculus
tttcactgctgaatatgtggagttt

SEQ ID NO: 111539 - DNA, 25 bp, mus musculus
cttcttcttccagcaagttcagccc

SEQ ID NO: 111540 - DNA, 25 bp, mus musculus
tcttcttccagcaagttcagccctt

SEQ ID NO: 111541 - DNA, 25 bp, mus musculus
ttcttccagcaagttcagcccttct

SEQ ID NO: 111542 - DNA, 25 bp, mus musculus
cttccagcaagttcagcccttcttt

SEQ ID NO: 111543 - DNA, 25 bp, mus musculus
cagcaagttcagcccttctttgaca

SEQ ID NO: 111544 - DNA, 25 bp, mus musculus
gcaagttcagcccttctttgacaac

SEQ ID NO: 111545 - DNA, 25 bp, mus musculus
aagttcagcccttctttgacaacat

SEQ ID NO: 111546 - DNA, 25 bp, mus musculus
gttcagcccttctttgacaacattt

SEQ ID NO: 111547 - DNA, 25 bp, mus musculus
cttctttgacaacatttttgtggct

SEQ ID NO: 111548 - DNA, 25 bp, mus musculus
tctttgacaacatttttgtggctgt

SEQ ID NO: 111549 - DNA, 25 bp, mus musculus
tcactgctgaatatgtggagtttga

SEQ ID NO: 111550 - DNA, 25 bp, mus musculus
ctgaccgaaatgagggccggagaca

SEQ ID NO: 111551 - DNA, 25 bp, mus musculus
gtcctcgttctccgtgagctggcca

SEQ ID NO: 111552 - DNA, 25 bp, mus musculus
cctcgttctccgtgagctggccatc

SEQ ID NO: 111553 - DNA, 25 bp, mus musculus
tctccgtgagctggccatcagtgtc

SEQ ID NO: 111554 - DNA, 25 bp, mus musculus
tccgtgagctggccatcagtgtccc

SEQ ID NO: 111555 - DNA, 25 bp, mus musculus
cgtgagctggccatcagtgtcccca

SEQ ID NO: 111556 - DNA, 25 bp, mus musculus
ccaccttcttcttccagcaagttca

SEQ ID NO: 111557 - DNA, 25 bp, mus musculus
ttctgttggactgtatggcacgccc

SEQ ID NO: 111558 - DNA, 25 bp, mus musculus
tggactgtatggcacgccctgggga

SEQ ID NO: 111559 - DNA, 25 bp, mus musculus
tgaccgataatgctttctttggcta

SEQ ID NO: 111560 - DNA, 25 bp, mus musculus
ataatgctttctttggctacattct

SEQ ID NO: 111561 - DNA, 25 bp, mus musculus
acattctttattctgcggtgacatt

SEQ ID NO: 111562 - DNA, 25 bp, mus musculus
tttattctgcggtgacattgaggct

SEQ ID NO: 111563 - DNA, 25 bp, mus musculus
tttatacagaactcacagtatctat

SEQ ID NO: 111564 - DNA, 25 bp, mus musculus
cagaactcacagtatctatgacttt

SEQ ID NO: 111565 - DNA, 25 bp, mus musculus
actacgacctgttaaatgaatctgt

SEQ ID NO: 111566 - DNA, 25 bp, mus musculus
aatctgtttgcacagatgcccgtgt

SEQ ID NO: 111567 - DNA, 25 bp, mus musculus
tttgcacagatgcccgtgtacaatg

SEQ ID NO: 111568 - DNA, 25 bp, mus musculus
cagatgcccgtgtacaatgccatgt

SEQ ID NO: 111569 - DNA, 25 bp, mus musculus
ccctccgtggggcctcagaagcagg

SEQ ID NO: 111570 - DNA, 25 bp, mus musculus
gacactttgtacagttcccatatag

SEQ ID NO: 111571 - DNA, 25 bp, mus musculus
ttgtacagttcccatatagtctatt

SEQ ID NO: 111572 - DNA, 25 bp, mus musculus
gtctattcactgagtgatcttttta

SEQ ID NO: 111573 - DNA, 25 bp, mus musculus
agtgatctttttacagttggatcag

SEQ ID NO: 111574 - DNA, 25 bp, mus musculus
ctttttacagttggatcaggcctga

SEQ ID NO: 111575 - DNA, 25 bp, mus musculus
ggcctgaacccgtccattcagaaag

SEQ ID NO: 111576 - DNA, 25 bp, mus musculus
aacactgtcctatacgagtgaccga

SEQ ID NO: 111577 - DNA, 25 bp, mus musculus
gctctgctcacagcaggcgctgctg

SEQ ID NO: 111578 - DNA, 25 bp, mus musculus
ctgctcacagcaggcgctgctgcac

SEQ ID NO: 111579 - DNA, 25 bp, mus musculus
aactatggctgctactgtggcttgg

SEQ ID NO: 111580 - DNA, 25 bp, mus musculus
ggcaccccagtggacgacttagaca

SEQ ID NO: 111581 - DNA, 25 bp, mus musculus
aggtgctgccagactcatgaccact

SEQ ID NO: 111582 - DNA, 25 bp, mus musculus
tgctgccagactcatgaccactgct

SEQ ID NO: 111583 - DNA, 25 bp, mus musculus
cagactcatgaccactgctacagtc

SEQ ID NO: 111584 - DNA, 25 bp, mus musculus
actcatgaccactgctacagtcagg

SEQ ID NO: 111585 - DNA, 25 bp, mus musculus
catgaccactgctacagtcaggcca

SEQ ID NO: 111586 - DNA, 25 bp, mus musculus
cactgctacagtcaggccaagaagc

SEQ ID NO: 111587 - DNA, 25 bp, mus musculus
tgctacagtcaggccaagaagctgg

SEQ ID NO: 111588 - DNA, 25 bp, mus musculus
agctgtaaattcctcatagacaacc

SEQ ID NO: 111589 - DNA, 25 bp, mus musculus
ctcacagcaggcgctgctgcacaca

SEQ ID NO: 111590 - DNA, 25 bp, mus musculus
accaacacttactcctactcatgct

SEQ ID NO: 111591 - DNA, 25 bp, mus musculus
gcacacagcatcagccctcgggtgt

SEQ ID NO: 111592 - DNA, 25 bp, mus musculus
cacagcatcagccctcgggtgtgat

SEQ ID NO: 111593 - DNA, 25 bp, mus musculus
agccctcgggtgtgatggcagttcc

SEQ ID NO: 111594 - DNA, 25 bp, mus musculus
tggcagttccgcaatatgatcaagt

SEQ ID NO: 111595 - DNA, 25 bp, mus musculus
cagttccgcaatatgatcaagtgca

SEQ ID NO: 111596 - DNA, 25 bp, mus musculus
agtgatcccctgaaggattacaaca

SEQ ID NO: 111597 - DNA, 25 bp, mus musculus
tacaacaactatggctgctactgtg

SEQ ID NO: 111598 - DNA, 25 bp, mus musculus
gacgttcttgagaccacgcatcatc

SEQ ID NO: 111599 - DNA, 25 bp, mus musculus
gttcttgagaccacgcatcatcggg

SEQ ID NO: 111600 - DNA, 25 bp, mus musculus
tcatcgggggctcatcatctttggc

SEQ ID NO: 111601 - DNA, 25 bp, mus musculus
ctcatcatctttggctgggtcacac

SEQ ID NO: 111602 - DNA, 25 bp, mus musculus
acacccctggctgggtgccatctac

SEQ ID NO: 111603 - DNA, 25 bp, mus musculus
gctgggtgccatctacattggggat

SEQ ID NO: 111604 - DNA, 25 bp, mus musculus
tgggtgccatctacattggggatag

SEQ ID NO: 111605 - DNA, 25 bp, mus musculus
gggtgccatctacattggggatagc

SEQ ID NO: 111606 - DNA, 25 bp, mus musculus
gtgccatctacattggggatagctt

SEQ ID NO: 111607 - DNA, 25 bp, mus musculus
tgccatctacattggggatagcttc

SEQ ID NO: 111608 - DNA, 25 bp, mus musculus
ccatctacattggggatagcttctg

SEQ ID NO: 111609 - DNA, 25 bp, mus musculus
ggatagcttctgtgcccggaagctt

SEQ ID NO: 111610 - DNA, 25 bp, mus musculus
tcttgagaccacgcatcatcggggg

SEQ ID NO: 111611 - DNA, 25 bp, mus musculus
cttgagaccacgcatcatcgggggc

SEQ ID NO: 111612 - DNA, 25 bp, mus musculus
tgagaccacgcatcatcgggggctc

SEQ ID NO: 111613 - DNA, 25 bp, mus musculus
gagaccacgcatcatcgggggctca

SEQ ID NO: 111614 - DNA, 25 bp, mus musculus
gaccacgcatcatcgggggctcatc

SEQ ID NO: 111615 - DNA, 25 bp, mus musculus
cacgcatcatcgggggctcatcatc

SEQ ID NO: 111616 - DNA, 25 bp, mus musculus
acgcatcatcgggggctcatcatct

SEQ ID NO: 111617 - DNA, 25 bp, mus musculus
catcatcgggggctcatcatctttg

SEQ ID NO: 111618 - DNA, 25 bp, mus musculus
atacaaactatctgatccattgatt

SEQ ID NO: 111619 - DNA, 25 bp, mus musculus
actatctgatccattgattttaatc

SEQ ID NO: 111620 - DNA, 25 bp, mus musculus
ttcgcacgaaacaccttttggcatg

SEQ ID NO: 111621 - DNA, 25 bp, mus musculus
ttttggcatgcttaactttctggta

SEQ ID NO: 111622 - DNA, 25 bp, mus musculus
tgacaagccttggatagctggctct

SEQ ID NO: 111623 - DNA, 25 bp, mus musculus
ttccctctctctatgtgaaggatgt

SEQ ID NO: 111624 - DNA, 25 bp, mus musculus
cctctctctatgtgaaggatgtatt

SEQ ID NO: 111625 - DNA, 25 bp, mus musculus
ggacatttgtcagctctgaatattg

SEQ ID NO: 111626 - DNA, 25 bp, mus musculus
catttgtcagctctgaatattgggt

SEQ ID NO: 111627 - DNA, 25 bp, mus musculus
tgcttcactaataattgccatgtga

SEQ ID NO: 111628 - DNA, 25 bp, mus musculus
ttcactaataattgccatgtgaatg

SEQ ID NO: 111629 - DNA, 25 bp, mus musculus
ttactctgcgttttcataatcaaag

SEQ ID NO: 111630 - DNA, 25 bp, mus musculus
ggcaaactttgcagctgataatgag

SEQ ID NO: 111631 - DNA, 25 bp, mus musculus
aaactttgcagctgataatgagtat

SEQ ID NO: 111632 - DNA, 25 bp, mus musculus
tttttacaaaattgccactgatttg

SEQ ID NO: 111633 - DNA, 25 bp, mus musculus
ttacaaaattgccactgatttggat

SEQ ID NO: 111634 - DNA, 25 bp, mus musculus
tgccactgatttggatttgtgcact

SEQ ID NO: 111635 - DNA, 25 bp, mus musculus
tttattgatgctctattgtgcagta

SEQ ID NO: 111636 - DNA, 25 bp, mus musculus
gatgctctattgtgcagtagcattt

SEQ ID NO: 111637 - DNA, 25 bp, mus musculus
taatatccaaaactagttggtaatg

SEQ ID NO: 111638 - DNA, 25 bp, mus musculus
gatcttggacaccgcgggcacgtag

SEQ ID NO: 111639 - DNA, 25 bp, mus musculus
cttggacaccgcgggcacgtagcag

SEQ ID NO: 111640 - DNA, 25 bp, mus musculus
gacatcaagcccatgcgggaccaga

SEQ ID NO: 111641 - DNA, 25 bp, mus musculus
aagcccatgcgggaccagatcatcc

SEQ ID NO: 111642 - DNA, 25 bp, mus musculus
cccatgcgggaccagatcatccgcg

SEQ ID NO: 111643 - DNA, 25 bp, mus musculus
atgcgggaccagatcatccgcgtga

SEQ ID NO: 111644 - DNA, 25 bp, mus musculus
cagatcatccgcgtgaacggtacga

SEQ ID NO: 111645 - DNA, 25 bp, mus musculus
atcatccgcgtgaacggtacgagcg

SEQ ID NO: 111646 - DNA, 25 bp, mus musculus
acgagcgcgtacccatgatcctggt

SEQ ID NO: 111647 - DNA, 25 bp, mus musculus
agcgcgtacccatgatcctggtagg

SEQ ID NO: 111648 - DNA, 25 bp, mus musculus
gcgtacccatgatcctggtaggcaa

SEQ ID NO: 111649 - DNA, 25 bp, mus musculus
tgatcctggtaggcaacaaggtgga

SEQ ID NO: 111650 - DNA, 25 bp, mus musculus
gttcgcctcaatgcggagacctgta

SEQ ID NO: 111651 - DNA, 25 bp, mus musculus
atggccagggcttcattctcgtcta

SEQ ID NO: 111652 - DNA, 25 bp, mus musculus
tcattctcgtctacagcctggtcaa

SEQ ID NO: 111653 - DNA, 25 bp, mus musculus
ttctcgtctacagcctggtcaacag

SEQ ID NO: 111654 - DNA, 25 bp, mus musculus
tctacagcctggtcaacagcagagt

SEQ ID NO: 111655 - DNA, 25 bp, mus musculus
tcaacagcagagttccaggacatca

SEQ ID NO: 111656 - DNA, 25 bp, mus musculus
ttccaggacatcaagcccatgcggg

SEQ ID NO: 111657 - DNA, 25 bp, mus musculus
caggacatcaagcccatgcgggacc

SEQ ID NO: 111658 - DNA, 25 bp, mus musculus
attatcatttcccctgaggagaatg

SEQ ID NO: 111659 - DNA, 25 bp, mus musculus
ttaacttgcacagcagaaaaccaac

SEQ ID NO: 111660 - DNA, 25 bp, mus musculus
gctgccctcgttgctggtgtcgtct

SEQ ID NO: 111661 - DNA, 25 bp, mus musculus
gccctcgttgctggtgtcgtctact

SEQ ID NO: 111662 - DNA, 25 bp, mus musculus
ctcgttgctggtgtcgtctactggc

SEQ ID NO: 111663 - DNA, 25 bp, mus musculus
gtcgtctactggctgtacatgaaga

SEQ ID NO: 111664 - DNA, 25 bp, mus musculus
aagtccaaaactgcatcaaaacatg

SEQ ID NO: 111665 - DNA, 25 bp, mus musculus
aaagcagttcattctaccaacctgt

SEQ ID NO: 111666 - DNA, 25 bp, mus musculus
gcagttcattctaccaacctgtcac

SEQ ID NO: 111667 - DNA, 25 bp, mus musculus
tctaccaacctgtcacaggatctta

SEQ ID NO: 111668 - DNA, 25 bp, mus musculus
accaacctgtcacaggatcttagag

SEQ ID NO: 111669 - DNA, 25 bp, mus musculus
ctgtcacaggatcttagagaattat

SEQ ID NO: 111670 - DNA, 25 bp, mus musculus
acttgcacagcagaaaaccaactgg

SEQ ID NO: 111671 - DNA, 25 bp, mus musculus
tgcacagcagaaaaccaactggaga

SEQ ID NO: 111672 - DNA, 25 bp, mus musculus
agaacagtaaactccctgaatgtct

SEQ ID NO: 111673 - DNA, 25 bp, mus musculus
aactccctgaatgtctctgcgataa

SEQ ID NO: 111674 - DNA, 25 bp, mus musculus
aatgtctctgcgataagtattccag

SEQ ID NO: 111675 - DNA, 25 bp, mus musculus
ataagtattccagagcacgatgagg

SEQ ID NO: 111676 - DNA, 25 bp, mus musculus
agtattccagagcacgatgaggcag

SEQ ID NO: 111677 - DNA, 25 bp, mus musculus
attccagagcacgatgaggcagacg

SEQ ID NO: 111678 - DNA, 25 bp, mus musculus
gacgttcagcctggccaacacgcac

SEQ ID NO: 111679 - DNA, 25 bp, mus musculus
cagcctggccaacacgcacgctgat

SEQ ID NO: 111680 - DNA, 25 bp, mus musculus
atcactggcaaggggatcctggcca

SEQ ID NO: 111681 - DNA, 25 bp, mus musculus
gggatcctggccatcatgagagccc

SEQ ID NO: 111682 - DNA, 25 bp, mus musculus
ctggccatcatgagagccctgcagc

SEQ ID NO: 111683 - DNA, 25 bp, mus musculus
atgagagccctgcagcacaacacgg

SEQ ID NO: 111684 - DNA, 25 bp, mus musculus
agagccctgcagcacaacacggtgc

SEQ ID NO: 111685 - DNA, 25 bp, mus musculus
cacaacacggtgctcacggagctgc

SEQ ID NO: 111686 - DNA, 25 bp, mus musculus
gtgctcacggagctgcgcttccaca

SEQ ID NO: 111687 - DNA, 25 bp, mus musculus
gagctgcgcttccacaaccagcggc

SEQ ID NO: 111688 - DNA, 25 bp, mus musculus
cacaaccagcggcacatcatgggct

SEQ ID NO: 111689 - DNA, 25 bp, mus musculus
cagcggcacatcatgggctctcagg

SEQ ID NO: 111690 - DNA, 25 bp, mus musculus
caacacgcacgctgatgacgccgcg

SEQ ID NO: 111691 - DNA, 25 bp, mus musculus
cacatcatgggctctcaggtggaga

SEQ ID NO: 111692 - DNA, 25 bp, mus musculus
cacgcacgctgatgacgccgcgcga

SEQ ID NO: 111693 - DNA, 25 bp, mus musculus
tgacgccgcgcgattgccattgcag

SEQ ID NO: 111694 - DNA, 25 bp, mus musculus
cgcgcgattgccattgcagacatgc

SEQ ID NO: 111695 - DNA, 25 bp, mus musculus
attgcagacatgctcaaggttaacg

SEQ ID NO: 111696 - DNA, 25 bp, mus musculus
gttaacgagcacattaccagcgtaa

SEQ ID NO: 111697 - DNA, 25 bp, mus musculus
cacattaccagcgtaaacgtggagt

SEQ ID NO: 111698 - DNA, 25 bp, mus musculus
gagtccaacttcatcactggcaagg

SEQ ID NO: 111699 - DNA, 25 bp, mus musculus
ccagtgactatcgggcagcaccact

SEQ ID NO: 111700 - DNA, 25 bp, mus musculus
actatcgggcagcaccacttccggt

SEQ ID NO: 111701 - DNA, 25 bp, mus musculus
accacatctgcctcttctagcggag

SEQ ID NO: 111702 - DNA, 25 bp, mus musculus
tctgcctcttctagcggagagcccg

SEQ ID NO: 111703 - DNA, 25 bp, mus musculus
tcttctagcggagagcccgaggtca

SEQ ID NO: 111704 - DNA, 25 bp, mus musculus
aaactcacgccacaggagccctagt

SEQ ID NO: 111705 - DNA, 25 bp, mus musculus
ccctagtggccagcagctacattca

SEQ ID NO: 111706 - DNA, 25 bp, mus musculus
tggccagcagctacattcaaggacc

SEQ ID NO: 111707 - DNA, 25 bp, mus musculus
gcagctacattcaaggaccgagtgg

SEQ ID NO: 111708 - DNA, 25 bp, mus musculus
acagcctgcagccctcatgtgggtg

SEQ ID NO: 111709 - DNA, 25 bp, mus musculus
acataaacacgtacagacaacttga

SEQ ID NO: 111710 - DNA, 25 bp, mus musculus
acacgtacagacaacttgattgtat

SEQ ID NO: 111711 - DNA, 25 bp, mus musculus
tccgggctgtcactcagaatggaaa

SEQ ID NO: 111712 - DNA, 25 bp, mus musculus
agcacggctgtacccacgaatagct

SEQ ID NO: 111713 - DNA, 25 bp, mus musculus
gctgtacccacgaatagcttgactg

SEQ ID NO: 111714 - DNA, 25 bp, mus musculus
cccacgaatagcttgactggcaatg

SEQ ID NO: 111715 - DNA, 25 bp, mus musculus
cagctcctggcagcccaggcaagtt

SEQ ID NO: 111716 - DNA, 25 bp, mus musculus
ctggcagcccaggcaagttcatcca

SEQ ID NO: 111717 - DNA, 25 bp, mus musculus
gcaagttcatccactccagtggtca

SEQ ID NO: 111718 - DNA, 25 bp, mus musculus
gccgtctcagtagccgctaatgcag

SEQ ID NO: 111719 - DNA, 25 bp, mus musculus
acatacgcaccagtgagcaggacac

SEQ ID NO: 111720 - DNA, 25 bp, mus musculus
cgatgatccttgtcactgccgacca

SEQ ID NO: 111721 - DNA, 25 bp, mus musculus
gtggcccacaggcgcacctggtgca

SEQ ID NO: 111722 - DNA, 25 bp, mus musculus
cgcacctggtgcacggagttcagga

SEQ ID NO: 111723 - DNA, 25 bp, mus musculus
tggtgcacggagttcaggagcagaa

SEQ ID NO: 111724 - DNA, 25 bp, mus musculus
actacatcgcgcacgtcatggcctt

SEQ ID NO: 111725 - DNA, 25 bp, mus musculus
tcgcgcacgtcatggccttcgcagc

SEQ ID NO: 111726 - DNA, 25 bp, mus musculus
acgtcatggccttcgcagcctgcct

SEQ ID NO: 111727 - DNA, 25 bp, mus musculus
cctacactgactgcggcctggcatc

SEQ ID NO: 111728 - DNA, 25 bp, mus musculus
tgagcccgggctacatgtccacctt

SEQ ID NO: 111729 - DNA, 25 bp, mus musculus
cgggctacatgtccaccttgctgtg

SEQ ID NO: 111730 - DNA, 25 bp, mus musculus
acatgtccaccttgctgtgcctgtt

SEQ ID NO: 111731 - DNA, 25 bp, mus musculus
gactggctcccttcaaggctgagga

SEQ ID NO: 111732 - DNA, 25 bp, mus musculus
ctcccttcaaggctgaggatggcaa

SEQ ID NO: 111733 - DNA, 25 bp, mus musculus
gtcctggttacaagctccataatgg

SEQ ID NO: 111734 - DNA, 25 bp, mus musculus
gttacaagctccataatggcgcccg

SEQ ID NO: 111735 - DNA, 25 bp, mus musculus
agctccataatggcgcccgggctga

SEQ ID NO: 111736 - DNA, 25 bp, mus musculus
ataatggcgcccgggctgatgtcac

SEQ ID NO: 111737 - DNA, 25 bp, mus musculus
cgtaccagcagcaggcctgtgtacc

SEQ ID NO: 111738 - DNA, 25 bp, mus musculus
caatattcgcgcgtggcccacaggc

SEQ ID NO: 111739 - DNA, 25 bp, mus musculus
agctgcaggtgcgctcatggtgtat

SEQ ID NO: 111740 - DNA, 25 bp, mus musculus
ctgcaggtgcgctcatggtgtatga

SEQ ID NO: 111741 - DNA, 25 bp, mus musculus
cacttaagcagctggttgacagacg

SEQ ID NO: 111742 - DNA, 25 bp, mus musculus
cttaagcagctggttgacagacgca

SEQ ID NO: 111743 - DNA, 25 bp, mus musculus
acgcaaggaatctcaccaatccaaa

SEQ ID NO: 111744 - DNA, 25 bp, mus musculus
gcaaggaatctcaccaatccaaaca

SEQ ID NO: 111745 - DNA, 25 bp, mus musculus
ggaatctcaccaatccaaacactgt

SEQ ID NO: 111746 - DNA, 25 bp, mus musculus
aatctcaccaatccaaacactgtaa

SEQ ID NO: 111747 - DNA, 25 bp, mus musculus
tctcaccaatccaaacactgtaata

SEQ ID NO: 111748 - DNA, 25 bp, mus musculus
tcaccaatccaaacactgtaataat

SEQ ID NO: 111749 - DNA, 25 bp, mus musculus
caatccaaacactgtaataattctc

SEQ ID NO: 111750 - DNA, 25 bp, mus musculus
atccaaacactgtaataattctcat

SEQ ID NO: 111751 - DNA, 25 bp, mus musculus
gcaggtgcgctcatggtgtatgaca

SEQ ID NO: 111752 - DNA, 25 bp, mus musculus
aggtgcgctcatggtgtatgacatc

SEQ ID NO: 111753 - DNA, 25 bp, mus musculus
tgtatgacatcaccagaagaagtac

SEQ ID NO: 111754 - DNA, 25 bp, mus musculus
tatgacatcaccagaagaagtacat

SEQ ID NO: 111755 - DNA, 25 bp, mus musculus
agtacatataaccacttaagcagct

SEQ ID NO: 111756 - DNA, 25 bp, mus musculus
tacatataaccacttaagcagctgg

SEQ ID NO: 111757 - DNA, 25 bp, mus musculus
catataaccacttaagcagctggtt

SEQ ID NO: 111758 - DNA, 25 bp, mus musculus
tataaccacttaagcagctggttga

SEQ ID NO: 111759 - DNA, 25 bp, mus musculus
cttcatgcgcctggtgggcaagaca

SEQ ID NO: 111760 - DNA, 25 bp, mus musculus
cgagaccctcatccgggacatgctt

SEQ ID NO: 111761 - DNA, 25 bp, mus musculus
aggccctagccttgtcctggcagac

SEQ ID NO: 111762 - DNA, 25 bp, mus musculus
tgtcctggcagaccttcaacagtct

SEQ ID NO: 111763 - DNA, 25 bp, mus musculus
ccttcaacagtctggagccagcatg

SEQ ID NO: 111764 - DNA, 25 bp, mus musculus
tggagccagcatgctggtgcctctg

SEQ ID NO: 111765 - DNA, 25 bp, mus musculus
cagcatgctggtgcctctggtgtca

SEQ ID NO: 111766 - DNA, 25 bp, mus musculus
gcctctggtgtcatgggtatctgga

SEQ ID NO: 111767 - DNA, 25 bp, mus musculus
atctggaaaggccactgcagctagg

SEQ ID NO: 111768 - DNA, 25 bp, mus musculus
cactgcagctaggcaggagtactat

SEQ ID NO: 111769 - DNA, 25 bp, mus musculus
gtactatgggccaggaggatcccct

SEQ ID NO: 111770 - DNA, 25 bp, mus musculus
tggatacatggtccacggagggcac

SEQ ID NO: 111771 - DNA, 25 bp, mus musculus
cctcatccgggacatgcttctgtca

SEQ ID NO: 111772 - DNA, 25 bp, mus musculus
catgcttctgtcagggagcaccttt

SEQ ID NO: 111773 - DNA, 25 bp, mus musculus
tctgtcagggagcacctttaactgg

SEQ ID NO: 111774 - DNA, 25 bp, mus musculus
cacctttaactggccctatggctcg

SEQ ID NO: 111775 - DNA, 25 bp, mus musculus
gccctatggctcgggctagtgatag

SEQ ID NO: 111776 - DNA, 25 bp, mus musculus
tggctcgggctagtgatagtcacct

SEQ ID NO: 111777 - DNA, 25 bp, mus musculus
ttccaggacacacatggaaactggg

SEQ ID NO: 111778 - DNA, 25 bp, mus musculus
atctccaggccctagccttgtcctg

SEQ ID NO: 111779 - DNA, 25 bp, mus musculus
cccaggacgtgtctctgctgcaacc

SEQ ID NO: 111780 - DNA, 25 bp, mus musculus
aggacgtgtctctgctgcaacctct

SEQ ID NO: 111781 - DNA, 25 bp, mus musculus
ttgctgacaccgcacactaccaggt

SEQ ID NO: 111782 - DNA, 25 bp, mus musculus
cacactaccaggttcagctcgcgca

SEQ ID NO: 111783 - DNA, 25 bp, mus musculus
actaccaggttcagctcgcgcagct

SEQ ID NO: 111784 - DNA, 25 bp, mus musculus
accaggttcagctcgcgcagctaca

SEQ ID NO: 111785 - DNA, 25 bp, mus musculus
aggttcagctcgcgcagctacatgg

SEQ ID NO: 111786 - DNA, 25 bp, mus musculus
agctcgcgcagctacatggtcacca

SEQ ID NO: 111787 - DNA, 25 bp, mus musculus
agctacatggtcaccaactgctcgt

SEQ ID NO: 111788 - DNA, 25 bp, mus musculus
tacatggtcaccaactgctcgtccg

SEQ ID NO: 111789 - DNA, 25 bp, mus musculus
tgctcgtccgagactccgtcatcga

SEQ ID NO: 111790 - DNA, 25 bp, mus musculus
tcgtccgagactccgtcatcgaagt

SEQ ID NO: 111791 - DNA, 25 bp, mus musculus
acgtgtctctgctgcaacctcttga

SEQ ID NO: 111792 - DNA, 25 bp, mus musculus
cgtccgagactccgtcatcgaagtg

SEQ ID NO: 111793 - DNA, 25 bp, mus musculus
ctctgctgcaacctcttgaagcggc

SEQ ID NO: 111794 - DNA, 25 bp, mus musculus
tgctgcaacctcttgaagcggcagg

SEQ ID NO: 111795 - DNA, 25 bp, mus musculus
tgcaacctcttgaagcggcaggact

SEQ ID NO: 111796 - DNA, 25 bp, mus musculus
aacctcttgaagcggcaggactggg

SEQ ID NO: 111797 - DNA, 25 bp, mus musculus
agttacagggaccgcctcttctgct

SEQ ID NO: 111798 - DNA, 25 bp, mus musculus
tacagggaccgcctcttctgcttca

SEQ ID NO: 111799 - DNA, 25 bp, mus musculus
tgcttcagtcggataacttcctcct

SEQ ID NO: 111800 - DNA, 25 bp, mus musculus
gagagccccttcaagtgcgatcctg

SEQ ID NO: 111801 - DNA, 25 bp, mus musculus
cccttcaagtgcgatcctgatgctg

SEQ ID NO: 111802 - DNA, 25 bp, mus musculus
tcactgccgacagatgtggataaat

SEQ ID NO: 111803 - DNA, 25 bp, mus musculus
ttccatcagcagaaaaactgaagag

SEQ ID NO: 111804 - DNA, 25 bp, mus musculus
aactgaagagcttcctctggaacac

SEQ ID NO: 111805 - DNA, 25 bp, mus musculus
agagcttcctctggaacacgagctg

SEQ ID NO: 111806 - DNA, 25 bp, mus musculus
gcttcctctggaacacgagctgtta

SEQ ID NO: 111807 - DNA, 25 bp, mus musculus
ggaacacgagctgttacggccgcat

SEQ ID NO: 111808 - DNA, 25 bp, mus musculus
acacgagctgttacggccgcatcct

SEQ ID NO: 111809 - DNA, 25 bp, mus musculus
cgagctgttacggccgcatcctgtt

SEQ ID NO: 111810 - DNA, 25 bp, mus musculus
gttacggccgcatcctgttcacctg

SEQ ID NO: 111811 - DNA, 25 bp, mus musculus
acggccgcatcctgttcacctggaa

SEQ ID NO: 111812 - DNA, 25 bp, mus musculus
ttcaagtgcgatcctgatgctgcca

SEQ ID NO: 111813 - DNA, 25 bp, mus musculus
tcctgttcacctggaagcattagat

SEQ ID NO: 111814 - DNA, 25 bp, mus musculus
gatcctgatgctgccaaagccattg

SEQ ID NO: 111815 - DNA, 25 bp, mus musculus
cctgatgctgccaaagccattgtgg

SEQ ID NO: 111816 - DNA, 25 bp, mus musculus
gatgctgccaaagccattgtggatg

SEQ ID NO: 111817 - DNA, 25 bp, mus musculus
aaagccattgtggatgctttgccac

SEQ ID NO: 111818 - DNA, 25 bp, mus musculus
ccatgtgaatctgcctgctcactgc

SEQ ID NO: 111819 - DNA, 25 bp, mus musculus
gaatctgcctgctcactgccgacag

SEQ ID NO: 111820 - DNA, 25 bp, mus musculus
tctgcctgctcactgccgacagatg

SEQ ID NO: 111821 - DNA, 25 bp, mus musculus
caacatggtctcagcagtgaaacag

SEQ ID NO: 111822 - DNA, 25 bp, mus musculus
tgctttcgcaccagttgtcagaccc

SEQ ID NO: 111823 - DNA, 25 bp, mus musculus
aaatcaccgaccttgcaaatactga

SEQ ID NO: 111824 - DNA, 25 bp, mus musculus
ccgaccttgcaaatactgaaattgg

SEQ ID NO: 111825 - DNA, 25 bp, mus musculus
gataaaaagcaagcccacattttct

SEQ ID NO: 111826 - DNA, 25 bp, mus musculus
tcttttcttaagcttaactctgcaa

SEQ ID NO: 111827 - DNA, 25 bp, mus musculus
cttaagcttaactctgcaaccattt

SEQ ID NO: 111828 - DNA, 25 bp, mus musculus
cttaactctgcaaccatttgtcttt

SEQ ID NO: 111829 - DNA, 25 bp, mus musculus
ttataaaccattaagctacacacaa

SEQ ID NO: 111830 - DNA, 25 bp, mus musculus
accattaagctacacacaagggcca

SEQ ID NO: 111831 - DNA, 25 bp, mus musculus
aagctacacacaagggccactataa

SEQ ID NO: 111832 - DNA, 25 bp, mus musculus
cacacaagggccactataaacaaga

SEQ ID NO: 111833 - DNA, 25 bp, mus musculus
cgcaccagttgtcagaccccagacg

SEQ ID NO: 111834 - DNA, 25 bp, mus musculus
caccagcaccaacgggaacagcctg

SEQ ID NO: 111835 - DNA, 25 bp, mus musculus
caccaacgggaacagcctgcaagcg

SEQ ID NO: 111836 - DNA, 25 bp, mus musculus
cagcctgcaagcgatatctggcatg

SEQ ID NO: 111837 - DNA, 25 bp, mus musculus
ttggattctgctacgaaagttatct

SEQ ID NO: 111838 - DNA, 25 bp, mus musculus
gttatctgacatgagtcccagagtg

SEQ ID NO: 111839 - DNA, 25 bp, mus musculus
tgacatgagtcccagagtggaactt

SEQ ID NO: 111840 - DNA, 25 bp, mus musculus
aatcacacaataactgcagattttt

SEQ ID NO: 111841 - DNA, 25 bp, mus musculus
atcatgcctcccaagaaggatgctc

SEQ ID NO: 111842 - DNA, 25 bp, mus musculus
atgcctcccaagaaggatgctcccg

SEQ ID NO: 111843 - DNA, 25 bp, mus musculus
cctgctgccaagtctacaccaggga

SEQ ID NO: 111844 - DNA, 25 bp, mus musculus
gctgccaagtctacaccagggaccc

SEQ ID NO: 111845 - DNA, 25 bp, mus musculus
cctgttgatctctccaaagtggtga

SEQ ID NO: 111846 - DNA, 25 bp, mus musculus
gttgatctctccaaagtggtgatcg

SEQ ID NO: 111847 - DNA, 25 bp, mus musculus
gatctctccaaagtggtgatcgagt

SEQ ID NO: 111848 - DNA, 25 bp, mus musculus
ctctccaaagtggtgatcgagttta

SEQ ID NO: 111849 - DNA, 25 bp, mus musculus
gaggcctttgagctgtttgaccgag

SEQ ID NO: 111850 - DNA, 25 bp, mus musculus
gcctttgagctgtttgaccgagtag

SEQ ID NO: 111851 - DNA, 25 bp, mus musculus
tttgagctgtttgaccgagtaggtg

SEQ ID NO: 111852 - DNA, 25 bp, mus musculus
tgagctgtttgaccgagtaggtgat

SEQ ID NO: 111853 - DNA, 25 bp, mus musculus
cctcccaagaaggatgctcccgtga

SEQ ID NO: 111854 - DNA, 25 bp, mus musculus
gacctgatgagggccctgggcacga

SEQ ID NO: 111855 - DNA, 25 bp, mus musculus
aaggatgctcccgtgaagaaaccag

SEQ ID NO: 111856 - DNA, 25 bp, mus musculus
gatgctcccgtgaagaaaccagcag

SEQ ID NO: 111857 - DNA, 25 bp, mus musculus
gcagggccctccatctctaagcctg

SEQ ID NO: 111858 - DNA, 25 bp, mus musculus
tccatctctaagcctgctgccaagt

SEQ ID NO: 111859 - DNA, 25 bp, mus musculus
atctctaagcctgctgccaagtcta

SEQ ID NO: 111860 - DNA, 25 bp, mus musculus
tctaagcctgctgccaagtctacac

SEQ ID NO: 111861 - DNA, 25 bp, mus musculus
aagcctgctgccaagtctacaccag

SEQ ID NO: 111862 - DNA, 25 bp, mus musculus
cctagtcctgcccgtgatgagtgct

SEQ ID NO: 111863 - DNA, 25 bp, mus musculus
cctgcccgtgatgagtgcttcgccc

SEQ ID NO: 111864 - DNA, 25 bp, mus musculus
tgctgtgacctgtctcctgaagata

SEQ ID NO: 111865 - DNA, 25 bp, mus musculus
gacctgtctcctgaagataagcaaa

SEQ ID NO: 111866 - DNA, 25 bp, mus musculus
atcaactgcttcaataccaactacc

SEQ ID NO: 111867 - DNA, 25 bp, mus musculus
tgcttcaataccaactacctgagga

SEQ ID NO: 111868 - DNA, 25 bp, mus musculus
ggcccaactcggggaacagatgcca

SEQ ID NO: 111869 - DNA, 25 bp, mus musculus
gcccctgggtccaaggaagaatgag

SEQ ID NO: 111870 - DNA, 25 bp, mus musculus
gaatgagtcaccctgagcctcagag

SEQ ID NO: 111871 - DNA, 25 bp, mus musculus
gtcaccctgagcctcagaggattag

SEQ ID NO: 111872 - DNA, 25 bp, mus musculus
ctgagcctcagaggattagatgggg

SEQ ID NO: 111873 - DNA, 25 bp, mus musculus
ctcgaacactcattacaataaatgc

SEQ ID NO: 111874 - DNA, 25 bp, mus musculus
tatcccaactatgaccgggatatct

SEQ ID NO: 111875 - DNA, 25 bp, mus musculus
gatatcttgacccttgacctcagcc

SEQ ID NO: 111876 - DNA, 25 bp, mus musculus
aacctcatgggccagctctgtggaa

SEQ ID NO: 111877 - DNA, 25 bp, mus musculus
atgggccagctctgtggaagtggaa

SEQ ID NO: 111878 - DNA, 25 bp, mus musculus
attccggggctgatccagaatatga

SEQ ID NO: 111879 - DNA, 25 bp, mus musculus
atccagaatatgaccgtccgctgct

SEQ ID NO: 111880 - DNA, 25 bp, mus musculus
tgcgagcttccatatccagaacagg

SEQ ID NO: 111881 - DNA, 25 bp, mus musculus
gcctgctgcggcgaagaggagaaac

SEQ ID NO: 111882 - DNA, 25 bp, mus musculus
actctaactacctgcaccgagtgac

SEQ ID NO: 111883 - DNA, 25 bp, mus musculus
gagtgactacactcttctgcatcac

SEQ ID NO: 111884 - DNA, 25 bp, mus musculus
ccactaagcacatgctgcccacagt

SEQ ID NO: 111885 - DNA, 25 bp, mus musculus
ctaagcacatgctgcccacagttct

SEQ ID NO: 111886 - DNA, 25 bp, mus musculus
acatgctgcccacagttcttcgtct

SEQ ID NO: 111887 - DNA, 25 bp, mus musculus
caggggacccagttgccgatgtccg

SEQ ID NO: 111888 - DNA, 25 bp, mus musculus
gggacccagttgccgatgtccgctt

SEQ ID NO: 111889 - DNA, 25 bp, mus musculus
cagttgccgatgtccgcttcaatgt

SEQ ID NO: 111890 - DNA, 25 bp, mus musculus
tcaatgtcgccacgtcactccagac

SEQ ID NO: 111891 - DNA, 25 bp, mus musculus
tcgccacgtcactccagacgatagg

SEQ ID NO: 111892 - DNA, 25 bp, mus musculus
cgataggacccattctcgatcacag

SEQ ID NO: 111893 - DNA, 25 bp, mus musculus
ttctcgatcacagcaccctgcagag

SEQ ID NO: 111894 - DNA, 25 bp, mus musculus
ctacactcttctgcatcactgtgca

SEQ ID NO: 111895 - DNA, 25 bp, mus musculus
cactcttctgcatcactgtgcagtc

SEQ ID NO: 111896 - DNA, 25 bp, mus musculus
tcttctgcatcactgtgcagtctga

SEQ ID NO: 111897 - DNA, 25 bp, mus musculus
gcatcactgtgcagtctgaggtctg

SEQ ID NO: 111898 - DNA, 25 bp, mus musculus
ctgtgcagtctgaggtctgtggaca

SEQ ID NO: 111899 - DNA, 25 bp, mus musculus
agtctgaggtctgtggacaggatct

SEQ ID NO: 111900 - DNA, 25 bp, mus musculus
gacaggatctcaccactaagcacat

SEQ ID NO: 111901 - DNA, 25 bp, mus musculus
aggatctcaccactaagcacatgct

SEQ ID NO: 111902 - DNA, 25 bp, mus musculus
cttattctacgacactagaaatctt

SEQ ID NO: 111903 - DNA, 25 bp, mus musculus
attctacgacactagaaatcttgat

SEQ ID NO: 111904 - DNA, 25 bp, mus musculus
ccattatcttctactgcaatatttc

SEQ ID NO: 111905 - DNA, 25 bp, mus musculus
ctgggctactatggccaagaatatt

SEQ ID NO: 111906 - DNA, 25 bp, mus musculus
tttatttcttacacgttcagaggag

SEQ ID NO: 111907 - DNA, 25 bp, mus musculus
atttcttacacgttcagaggagtgt

SEQ ID NO: 111908 - DNA, 25 bp, mus musculus
gtgttacaggtctccttgttacata

SEQ ID NO: 111909 - DNA, 25 bp, mus musculus
gtctccttgttacataattttcaat

SEQ ID NO: 111910 - DNA, 25 bp, mus musculus
aattttcaataatctgctttaatag

SEQ ID NO: 111911 - DNA, 25 bp, mus musculus
tctataccatgtatgtaccaattca

SEQ ID NO: 111912 - DNA, 25 bp, mus musculus
ataccatgtatgtaccaattcacag

SEQ ID NO: 111913 - DNA, 25 bp, mus musculus
taccaattcacaggttagtaaatga

SEQ ID NO: 111914 - DNA, 25 bp, mus musculus
ctacgacactagaaatcttgattta

SEQ ID NO: 111915 - DNA, 25 bp, mus musculus
gaattgcttctgttctttgtacagt

SEQ ID NO: 111916 - DNA, 25 bp, mus musculus
cttctgttctttgtacagttctgaa

SEQ ID NO: 111917 - DNA, 25 bp, mus musculus
tgtcttcagttttgctaatcgcctg

SEQ ID NO: 111918 - DNA, 25 bp, mus musculus
cttcagttttgctaatcgcctgtga

SEQ ID NO: 111919 - DNA, 25 bp, mus musculus
tgctaatcgcctgtgaaaagcatag

SEQ ID NO: 111920 - DNA, 25 bp, mus musculus
taatcgcctgtgaaaagcatagata

SEQ ID NO: 111921 - DNA, 25 bp, mus musculus
ctgccattatcttctactgcaatat

SEQ ID NO: 111922 - DNA, 25 bp, mus musculus
cgagctccggactgcccagtttgaa

SEQ ID NO: 111923 - DNA, 25 bp, mus musculus
gctccggactgcccagtttgaaaag

SEQ ID NO: 111924 - DNA, 25 bp, mus musculus
cactctgcagcttcaaaagccgaga

SEQ ID NO: 111925 - DNA, 25 bp, mus musculus
gcagcttcaaaagccgagagatgcc

SEQ ID NO: 111926 - DNA, 25 bp, mus musculus
gcttcaaaagccgagagatgcctaa

SEQ ID NO: 111927 - DNA, 25 bp, mus musculus
caccacaatcaacatgcctgagatc

SEQ ID NO: 111928 - DNA, 25 bp, mus musculus
cacaatcaacatgcctgagatctcc

SEQ ID NO: 111929 - DNA, 25 bp, mus musculus
aatcaacatgcctgagatctccacg

SEQ ID NO: 111930 - DNA, 25 bp, mus musculus
caacatgcctgagatctccacgcct

SEQ ID NO: 111931 - DNA, 25 bp, mus musculus
catgcctgagatctccacgcctgac

SEQ ID NO: 111932 - DNA, 25 bp, mus musculus
gcctgagatctccacgcctgaccat

SEQ ID NO: 111933 - DNA, 25 bp, mus musculus
tgagatctccacgcctgaccatgtg

SEQ ID NO: 111934 - DNA, 25 bp, mus musculus
gactgcccagtttgaaaagccttct

SEQ ID NO: 111935 - DNA, 25 bp, mus musculus
tgaaaagccttctcattccttcctt

SEQ ID NO: 111936 - DNA, 25 bp, mus musculus
gccttctcattccttccttattctc

SEQ ID NO: 111937 - DNA, 25 bp, mus musculus
ttccttccttattctcactctgcag

SEQ ID NO: 111938 - DNA, 25 bp, mus musculus
cttccttattctcactctgcagctt

SEQ ID NO: 111939 - DNA, 25 bp, mus musculus
ccttattctcactctgcagcttcaa

SEQ ID NO: 111940 - DNA, 25 bp, mus musculus
tattctcactctgcagcttcaaaag

SEQ ID NO: 111941 - DNA, 25 bp, mus musculus
tctcactctgcagcttcaaaagccg

SEQ ID NO: 111942 - DNA, 25 bp, mus musculus
actgtacacagaagccttggggata

SEQ ID NO: 111943 - DNA, 25 bp, mus musculus
tacacagaagccttggggatagatc

SEQ ID NO: 111944 - DNA, 25 bp, mus musculus
ctcgatgacacttacatcaaagcct

SEQ ID NO: 111945 - DNA, 25 bp, mus musculus
atgacacttacatcaaagcctacct

SEQ ID NO: 111946 - DNA, 25 bp, mus musculus
cacttacatcaaagcctacctgaga

SEQ ID NO: 111947 - DNA, 25 bp, mus musculus
tacatcaaagcctacctgagaagag

SEQ ID NO: 111948 - DNA, 25 bp, mus musculus
catcaaagcctacctgagaagagct

SEQ ID NO: 111949 - DNA, 25 bp, mus musculus
aaagcctacctgagaagagctcagt

SEQ ID NO: 111950 - DNA, 25 bp, mus musculus
cctacctgagaagagctcagtgtta

SEQ ID NO: 111951 - DNA, 25 bp, mus musculus
aagagctcagtgttacatggacaca

SEQ ID NO: 111952 - DNA, 25 bp, mus musculus
agaagccgtgcgtgactatgaaaaa

SEQ ID NO: 111953 - DNA, 25 bp, mus musculus
aagccgtgcgtgactatgaaaaagt

SEQ ID NO: 111954 - DNA, 25 bp, mus musculus
cacagaagccttggggatagatccc

SEQ ID NO: 111955 - DNA, 25 bp, mus musculus
agaacacaaacagctccttaagaat

SEQ ID NO: 111956 - DNA, 25 bp, mus musculus
caaatgctaaactctactgtaatcg

SEQ ID NO: 111957 - DNA, 25 bp, mus musculus
aatgctaaactctactgtaatcggg

SEQ ID NO: 111958 - DNA, 25 bp, mus musculus
tgctaaactctactgtaatcggggt

SEQ ID NO: 111959 - DNA, 25 bp, mus musculus
gttaattccaagcttaggcaactgg

SEQ ID NO: 111960 - DNA, 25 bp, mus musculus
taattccaagcttaggcaactggaa

SEQ ID NO: 111961 - DNA, 25 bp, mus musculus
attccaagcttaggcaactggaaga

SEQ ID NO: 111962 - DNA, 25 bp, mus musculus
agctcgatgacacttacatcaaagc

SEQ ID NO: 111963 - DNA, 25 bp, mus musculus
gcgtcgctcactcgatcaatgagct

SEQ ID NO: 111964 - DNA, 25 bp, mus musculus
gtcgctcactcgatcaatgagctca

SEQ ID NO: 111965 - DNA, 25 bp, mus musculus
tagagaaaatcttcccagtcatttc

SEQ ID NO: 111966 - DNA, 25 bp, mus musculus
agagaaaatcttcccagtcatttca

SEQ ID NO: 111967 - DNA, 25 bp, mus musculus
ccagtcatttcaagttcaaggagta

SEQ ID NO: 111968 - DNA, 25 bp, mus musculus
cagtcatttcaagttcaaggagtat

SEQ ID NO: 111969 - DNA, 25 bp, mus musculus
agtcatttcaagttcaaggagtatt

SEQ ID NO: 111970 - DNA, 25 bp, mus musculus
tcatttcaagttcaaggagtattgt

SEQ ID NO: 111971 - DNA, 25 bp, mus musculus
gagtattgtccccaggtcttcagga

SEQ ID NO: 111972 - DNA, 25 bp, mus musculus
ttgtccccaggtcttcaggaacctg

SEQ ID NO: 111973 - DNA, 25 bp, mus musculus
tgtccccaggtcttcaggaacctga

SEQ ID NO: 111974 - DNA, 25 bp, mus musculus
gtccccaggtcttcaggaacctgag

SEQ ID NO: 111975 - DNA, 25 bp, mus musculus
tcgctcactcgatcaatgagctcag

SEQ ID NO: 111976 - DNA, 25 bp, mus musculus
cgctcactcgatcaatgagctcagc

SEQ ID NO: 111977 - DNA, 25 bp, mus musculus
gctcactcgatcaatgagctcagcc

SEQ ID NO: 111978 - DNA, 25 bp, mus musculus
tcactcgatcaatgagctcagccag

SEQ ID NO: 111979 - DNA, 25 bp, mus musculus
cactcgatcaatgagctcagccagg

SEQ ID NO: 111980 - DNA, 25 bp, mus musculus
gatcaatgagctcagccaggtaccg

SEQ ID NO: 111981 - DNA, 25 bp, mus musculus
atcaatgagctcagccaggtaccgc

SEQ ID NO: 111982 - DNA, 25 bp, mus musculus
tcaatgagctcagccaggtaccgcc

SEQ ID NO: 111983 - DNA, 25 bp, mus musculus
tacagacaccaaagccttcattctc

SEQ ID NO: 111984 - DNA, 25 bp, mus musculus
caccaaagccttcattctctactca

SEQ ID NO: 111985 - DNA, 25 bp, mus musculus
tggtctgttcatctgttgcagctca

SEQ ID NO: 111986 - DNA, 25 bp, mus musculus
ccttgatgccctcttcatggattta

SEQ ID NO: 111987 - DNA, 25 bp, mus musculus
tgtatcctttcaaccttggctcata

SEQ ID NO: 111988 - DNA, 25 bp, mus musculus
accttggctcatacctgtattatgt

SEQ ID NO: 111989 - DNA, 25 bp, mus musculus
gctcatacctgtattatgtttgcac

SEQ ID NO: 111990 - DNA, 25 bp, mus musculus
ctcatgctgatgtgacttggttgat

SEQ ID NO: 111991 - DNA, 25 bp, mus musculus
atgctgatgtgacttggttgattct

SEQ ID NO: 111992 - DNA, 25 bp, mus musculus
tgacttggttgattctcgcttacaa

SEQ ID NO: 111993 - DNA, 25 bp, mus musculus
ggttgattctcgcttacaatagatc

SEQ ID NO: 111994 - DNA, 25 bp, mus musculus
ttctcgcttacaatagatcaggata

SEQ ID NO: 111995 - DNA, 25 bp, mus musculus
agccttcattctctactcatgaaga

SEQ ID NO: 111996 - DNA, 25 bp, mus musculus
cattctctactcatgaagatcgcca

SEQ ID NO: 111997 - DNA, 25 bp, mus musculus
tctctactcatgaagatcgccatta

SEQ ID NO: 111998 - DNA, 25 bp, mus musculus
ctactcatgaagatcgccattacta

SEQ ID NO: 111999 - DNA, 25 bp, mus musculus
attactatcactgtggtctggtctg

SEQ ID NO: 112000 - DNA, 25 bp, mus musculus
actatcactgtggtctggtctgttc

SEQ ID NO: 112001 - DNA, 25 bp, mus musculus
atcactgtggtctggtctgttcatc

SEQ ID NO: 112002 - DNA, 25 bp, mus musculus
gtggtctggtctgttcatctgttgc

SEQ ID NO: 112003 - DNA, 25 bp, mus musculus
ataggcctcagtaagttcagggaag

SEQ ID NO: 112004 - DNA, 25 bp, mus musculus
ggcctcagtaagttcagggaaggtg

SEQ ID NO: 112005 - DNA, 25 bp, mus musculus
tccagtatcccatcctgtcccgatt

SEQ ID NO: 112006 - DNA, 25 bp, mus musculus
gtttctatgcagacaatccattcct

SEQ ID NO: 112007 - DNA, 25 bp, mus musculus
tctatgcagacaatccattccttag

SEQ ID NO: 112008 - DNA, 25 bp, mus musculus
atgcagacaatccattccttagggg

SEQ ID NO: 112009 - DNA, 25 bp, mus musculus
tcccttctgaagtgttgtcactaca

SEQ ID NO: 112010 - DNA, 25 bp, mus musculus
tgttgtcactacagccctgtggagt

SEQ ID NO: 112011 - DNA, 25 bp, mus musculus
gaaggccagtgcatgctctgactta

SEQ ID NO: 112012 - DNA, 25 bp, mus musculus
ggccagtgcatgctctgacttactg

SEQ ID NO: 112013 - DNA, 25 bp, mus musculus
cagtgcatgctctgacttactgttg

SEQ ID NO: 112014 - DNA, 25 bp, mus musculus
tgcatgctctgacttactgttggag

SEQ ID NO: 112015 - DNA, 25 bp, mus musculus
taatggccagatttcagtggggttg

SEQ ID NO: 112016 - DNA, 25 bp, mus musculus
ccagatttcagtggggttgaggcca

SEQ ID NO: 112017 - DNA, 25 bp, mus musculus
ttcagtggggttgaggccagccctg

SEQ ID NO: 112018 - DNA, 25 bp, mus musculus
gccagccctgtgcctgttaagagta

SEQ ID NO: 112019 - DNA, 25 bp, mus musculus
agccctgtgcctgttaagagtaatg

SEQ ID NO: 112020 - DNA, 25 bp, mus musculus
tgttttgtatccccaggaagggcag

SEQ ID NO: 112021 - DNA, 25 bp, mus musculus
tttgtatccccaggaagggcagtgg

SEQ ID NO: 112022 - DNA, 25 bp, mus musculus
tccccaggaagggcagtggaactca

SEQ ID NO: 112023 - DNA, 25 bp, mus musculus
tgctcctgataggaacctttgtggc

SEQ ID NO: 112024 - DNA, 25 bp, mus musculus
ttcagccaactctgacccagcctga

SEQ ID NO: 112025 - DNA, 25 bp, mus musculus
tctactattacgcagaagaggaaca

SEQ ID NO: 112026 - DNA, 25 bp, mus musculus
aggaacactatcggcccgctgacat

SEQ ID NO: 112027 - DNA, 25 bp, mus musculus
ctaccgtggatgcagcccacaacgc

SEQ ID NO: 112028 - DNA, 25 bp, mus musculus
acaacgcctgtatcctcaccatcag

SEQ ID NO: 112029 - DNA, 25 bp, mus musculus
atgatgccgattacttctgttccat

SEQ ID NO: 112030 - DNA, 25 bp, mus musculus
ccgattacttctgttccatcgccca

SEQ ID NO: 112031 - DNA, 25 bp, mus musculus
ttgaacatcttctgtctcctaggtc

SEQ ID NO: 112032 - DNA, 25 bp, mus musculus
gctttctttccttcctctgtgaaat

SEQ ID NO: 112033 - DNA, 25 bp, mus musculus
tttccttcctctgtgaaatgagtta

SEQ ID NO: 112034 - DNA, 25 bp, mus musculus
aaccactgtcctgagaactgtgaga

SEQ ID NO: 112035 - DNA, 25 bp, mus musculus
caactctgacccagcctgacgcgtt

SEQ ID NO: 112036 - DNA, 25 bp, mus musculus
agcctgacgcgttctcagtcttccc

SEQ ID NO: 112037 - DNA, 25 bp, mus musculus
acgcgttctcagtcttcccaggcca

SEQ ID NO: 112038 - DNA, 25 bp, mus musculus
aagacgctcatctcagctgcaccat

SEQ ID NO: 112039 - DNA, 25 bp, mus musculus
ctcatctcagctgcaccatcaattc

SEQ ID NO: 112040 - DNA, 25 bp, mus musculus
atgccaccgctggagatattggggt

SEQ ID NO: 112041 - DNA, 25 bp, mus musculus
tgtcgtggtaccagcagcagccagg

SEQ ID NO: 112042 - DNA, 25 bp, mus musculus
ggtaccagcagcagccaggaagtgc

SEQ ID NO: 112043 - DNA, 25 bp, mus musculus
ggcagatcctgcctggggatccttt

SEQ ID NO: 112044 - DNA, 25 bp, mus musculus
tagctgagacgcgcaaccacaacgg

SEQ ID NO: 112045 - DNA, 25 bp, mus musculus
ctgacatcactcagcactcacttgc

SEQ ID NO: 112046 - DNA, 25 bp, mus musculus
agcactcacttgctaccaatctatt

SEQ ID NO: 112047 - DNA, 25 bp, mus musculus
tctctgcaggctggactggcaggct

SEQ ID NO: 112048 - DNA, 25 bp, mus musculus
gggacacggctcttaacattttcag

SEQ ID NO: 112049 - DNA, 25 bp, mus musculus
aacgcgcagatgtccaaaagtctaa

SEQ ID NO: 112050 - DNA, 25 bp, mus musculus
tgcattcagaggtttttggggtcca

SEQ ID NO: 112051 - DNA, 25 bp, mus musculus
aagtgcctccaggaagcagcagcct

SEQ ID NO: 112052 - DNA, 25 bp, mus musculus
ctccaggaagcagcagcctgcctta

SEQ ID NO: 112053 - DNA, 25 bp, mus musculus
gaagcagcagcctgccttagacttg

SEQ ID NO: 112054 - DNA, 25 bp, mus musculus
tgccttagacttgcagcccgctgtg

SEQ ID NO: 112055 - DNA, 25 bp, mus musculus
gcaaccacaacggcctgaaagaggg

SEQ ID NO: 112056 - DNA, 25 bp, mus musculus
gccttagacttgcagcccgctgtgg

SEQ ID NO: 112057 - DNA, 25 bp, mus musculus
cagcgctggacaacttcctggacaa

SEQ ID NO: 112058 - DNA, 25 bp, mus musculus
acttcctggacaaactgtaggcagc

SEQ ID NO: 112059 - DNA, 25 bp, mus musculus
aggcagcctgatactgccacatgct

SEQ ID NO: 112060 - DNA, 25 bp, mus musculus
cctgatactgccacatgctgcacag

SEQ ID NO: 112061 - DNA, 25 bp, mus musculus
acccatcagaagacaccttgagact

SEQ ID NO: 112062 - DNA, 25 bp, mus musculus
cagaagacaccttgagactgtccaa

SEQ ID NO: 112063 - DNA, 25 bp, mus musculus
agtgctcctctagaggctgctgggg

SEQ ID NO: 112064 - DNA, 25 bp, mus musculus
ccagggaccaggccctgaaagctct

SEQ ID NO: 112065 - DNA, 25 bp, mus musculus
accaggccctgaaagctctgcgggc

SEQ ID NO: 112066 - DNA, 25 bp, mus musculus
ccgagtctgtgccagtgggacctaa

SEQ ID NO: 112067 - DNA, 25 bp, mus musculus
ctgtgccagtgggacctaaagtccg

SEQ ID NO: 112068 - DNA, 25 bp, mus musculus
gaaagtatcagctctttgccttcat

SEQ ID NO: 112069 - DNA, 25 bp, mus musculus
atcagctctttgccttcattagtca

SEQ ID NO: 112070 - DNA, 25 bp, mus musculus
tctttgccttcattagtcacatggg

SEQ ID NO: 112071 - DNA, 25 bp, mus musculus
ccttcattagtcacatgggcacatc

SEQ ID NO: 112072 - DNA, 25 bp, mus musculus
ttagtcacatgggcacatctactat

SEQ ID NO: 112073 - DNA, 25 bp, mus musculus
gcacatctactatgtgtggtcacta

SEQ ID NO: 112074 - DNA, 25 bp, mus musculus
tgtgtggtcactatgtctgccatat

SEQ ID NO: 112075 - DNA, 25 bp, mus musculus
gtcactatgtctgccatatcaagaa

SEQ ID NO: 112076 - DNA, 25 bp, mus musculus
aagctctgcgggccacgaacaatag

SEQ ID NO: 112077 - DNA, 25 bp, mus musculus
actggatcttcagccacattgatga

SEQ ID NO: 112078 - DNA, 25 bp, mus musculus
tcttcagccacattgatgacctgga

SEQ ID NO: 112079 - DNA, 25 bp, mus musculus
ttgatgacctggacgcagaagctgc

SEQ ID NO: 112080 - DNA, 25 bp, mus musculus
aagctgctatggacatctcagaggg

SEQ ID NO: 112081 - DNA, 25 bp, mus musculus
ctatggacatctcagagggacgctc

SEQ ID NO: 112082 - DNA, 25 bp, mus musculus
gacgctcagcggctgagtccatctc

SEQ ID NO: 112083 - DNA, 25 bp, mus musculus
ctgagtccatctccgagtctgtgcc

SEQ ID NO: 112084 - DNA, 25 bp, mus musculus
ctgcgacttttgcttcttgctttaa

SEQ ID NO: 112085 - DNA, 25 bp, mus musculus
cttcttgctttaagcagttccactg

SEQ ID NO: 112086 - DNA, 25 bp, mus musculus
aacactataacttttgctatgatat

SEQ ID NO: 112087 - DNA, 25 bp, mus musculus
atgatatactgccaagtgtggccca

SEQ ID NO: 112088 - DNA, 25 bp, mus musculus
tactgccaagtgtggcccatgctca

SEQ ID NO: 112089 - DNA, 25 bp, mus musculus
caagtgtggcccatgctcataattg

SEQ ID NO: 112090 - DNA, 25 bp, mus musculus
tggcccatgctcataattgtgcctt

SEQ ID NO: 112091 - DNA, 25 bp, mus musculus
ataattgtgccttctgaattgtgat

SEQ ID NO: 112092 - DNA, 25 bp, mus musculus
gtgccttctgaattgtgataaatta

SEQ ID NO: 112093 - DNA, 25 bp, mus musculus
ttcccagtgaaaacgctcaattctg

SEQ ID NO: 112094 - DNA, 25 bp, mus musculus
gtgaaaacgctcaattctgctgttt

SEQ ID NO: 112095 - DNA, 25 bp, mus musculus
aattctgctgtttccatagaatttt

SEQ ID NO: 112096 - DNA, 25 bp, mus musculus
agcagttccactgaagatactcaaa

SEQ ID NO: 112097 - DNA, 25 bp, mus musculus
ataagctgtgtcttcttcactggac

SEQ ID NO: 112098 - DNA, 25 bp, mus musculus
tttccttttgcctcagaaggagtgg

SEQ ID NO: 112099 - DNA, 25 bp, mus musculus
agcaggtgaccccatgctctgtcaa

SEQ ID NO: 112100 - DNA, 25 bp, mus musculus
catgctctgtcaacccctgaataaa

SEQ ID NO: 112101 - DNA, 25 bp, mus musculus
ctgtcaacccctgaataaatgatgt

SEQ ID NO: 112102 - DNA, 25 bp, mus musculus
aagtcttagctcactctcaggaacg

SEQ ID NO: 112103 - DNA, 25 bp, mus musculus
tagctcactctcaggaacgcttgga

SEQ ID NO: 112104 - DNA, 25 bp, mus musculus
ggattgttggctctgatgtgtccaa

SEQ ID NO: 112105 - DNA, 25 bp, mus musculus
attgttggctctgatgtgtccaagc

SEQ ID NO: 112106 - DNA, 25 bp, mus musculus
gcaaacattccactgcccctgggga

SEQ ID NO: 112107 - DNA, 25 bp, mus musculus
tccactgcccctggggactgtgacc

SEQ ID NO: 112108 - DNA, 25 bp, mus musculus
cactgcccctggggactgtgaccat

SEQ ID NO: 112109 - DNA, 25 bp, mus musculus
actgtgaccatcctctgcattgact

SEQ ID NO: 112110 - DNA, 25 bp, mus musculus
tgtgaccatcctctgcattgacttg

SEQ ID NO: 112111 - DNA, 25 bp, mus musculus
accatcctctgcattgacttgggca

SEQ ID NO: 112112 - DNA, 25 bp, mus musculus
gggcactgacatggttcctgccatc

SEQ ID NO: 112113 - DNA, 25 bp, mus musculus
actgacatggttcctgccatctccc

SEQ ID NO: 112114 - DNA, 25 bp, mus musculus
tgacatggttcctgccatctccctg

SEQ ID NO: 112115 - DNA, 25 bp, mus musculus
ctccctggcctacgagcaagctgag

SEQ ID NO: 112116 - DNA, 25 bp, mus musculus
ctctgatgtgtccaagcaagctgct

SEQ ID NO: 112117 - DNA, 25 bp, mus musculus
tgtgtccaagcaagctgctgacatg

SEQ ID NO: 112118 - DNA, 25 bp, mus musculus
caagcaagctgctgacatgatcctt

SEQ ID NO: 112119 - DNA, 25 bp, mus musculus
caagctgctgacatgatccttctgg

SEQ ID NO: 112120 - DNA, 25 bp, mus musculus
gaagaaatccatcgcttacacccta

SEQ ID NO: 112121 - DNA, 25 bp, mus musculus
attattgcaaacattccactgcccc

SEQ ID NO: 112122 - DNA, 25 bp, mus musculus
tattgcaaacattccactgcccctg

SEQ ID NO: 112123 - DNA, 25 bp, mus musculus
ttgcaaacattccactgcccctggg

SEQ ID NO: 112124 - DNA, 25 bp, mus musculus
tccttgcccatgatgcatcagagca

SEQ ID NO: 112125 - DNA, 25 bp, mus musculus
tggtagcattgcgctcatatccgcc

SEQ ID NO: 112126 - DNA, 25 bp, mus musculus
agtcagcctagtgattgctatctac

SEQ ID NO: 112127 - DNA, 25 bp, mus musculus
gcaagtttgctctggatgtgtccca

SEQ ID NO: 112128 - DNA, 25 bp, mus musculus
aagtttgctctggatgtgtcccatt

SEQ ID NO: 112129 - DNA, 25 bp, mus musculus
gtttgctctggatgtgtcccattcg

SEQ ID NO: 112130 - DNA, 25 bp, mus musculus
ttgctctggatgtgtcccattcgaa

SEQ ID NO: 112131 - DNA, 25 bp, mus musculus
tctggatgtgtcccattcgaacata

SEQ ID NO: 112132 - DNA, 25 bp, mus musculus
gatgtgtcccattcgaacataagaa

SEQ ID NO: 112133 - DNA, 25 bp, mus musculus
tgtgtcccattcgaacataagaaca

SEQ ID NO: 112134 - DNA, 25 bp, mus musculus
tgtcccattcgaacataagaacaga

SEQ ID NO: 112135 - DNA, 25 bp, mus musculus
tcccattcgaacataagaacagatc

SEQ ID NO: 112136 - DNA, 25 bp, mus musculus
agcattgcgctcatatccgccttga

SEQ ID NO: 112137 - DNA, 25 bp, mus musculus
cattgcgctcatatccgccttgact

SEQ ID NO: 112138 - DNA, 25 bp, mus musculus
ttgcgctcatatccgccttgactgg

SEQ ID NO: 112139 - DNA, 25 bp, mus musculus
gcgctcatatccgccttgactggga

SEQ ID NO: 112140 - DNA, 25 bp, mus musculus
gctcatatccgccttgactgggaaa

SEQ ID NO: 112141 - DNA, 25 bp, mus musculus
atccgccttgactgggaaaatgagt

SEQ ID NO: 112142 - DNA, 25 bp, mus musculus
ccgccttgactgggaaaatgagtca

SEQ ID NO: 112143 - DNA, 25 bp, mus musculus
tgagtcagcctagtgattgctatct

SEQ ID NO: 112144 - DNA, 25 bp, mus musculus
ctggttaccacggacacaggtgtca

SEQ ID NO: 112145 - DNA, 25 bp, mus musculus
atgggctgactctaccagtggagaa

SEQ ID NO: 112146 - DNA, 25 bp, mus musculus
tggctagctcccactgaggaggacc

SEQ ID NO: 112147 - DNA, 25 bp, mus musculus
gctcccactgaggaggacctgagct

SEQ ID NO: 112148 - DNA, 25 bp, mus musculus
aaccttcagaggctacttctgagac

SEQ ID NO: 112149 - DNA, 25 bp, mus musculus
ttcgttacacgttctacatagagga

SEQ ID NO: 112150 - DNA, 25 bp, mus musculus
atttcaccagcagccatgaaaacgt

SEQ ID NO: 112151 - DNA, 25 bp, mus musculus
tcttcattcatttccagttgctacc

SEQ ID NO: 112152 - DNA, 25 bp, mus musculus
ttcatttccagttgctaccctgact

SEQ ID NO: 112153 - DNA, 25 bp, mus musculus
tgggcctcctgtaattgctctgtta

SEQ ID NO: 112154 - DNA, 25 bp, mus musculus
tcctgtaattgctctgttaaaagaa

SEQ ID NO: 112155 - DNA, 25 bp, mus musculus
aacagaccatgcccgctgggatccg

SEQ ID NO: 112156 - DNA, 25 bp, mus musculus
tgactctaccagtggagaatcccct

SEQ ID NO: 112157 - DNA, 25 bp, mus musculus
cgctgggatccggatcagaagaaag

SEQ ID NO: 112158 - DNA, 25 bp, mus musculus
tggagaatcccctatacacatatga

SEQ ID NO: 112159 - DNA, 25 bp, mus musculus
atcccctatacacatatgaccacac

SEQ ID NO: 112160 - DNA, 25 bp, mus musculus
catatgaccacactacagtcttggc

SEQ ID NO: 112161 - DNA, 25 bp, mus musculus
tcttggctgtggtggctgtagtact

SEQ ID NO: 112162 - DNA, 25 bp, mus musculus
gtcttcttgtcatcgtgggacttct

SEQ ID NO: 112163 - DNA, 25 bp, mus musculus
ttgtcatcgtgggacttctcatgtt

SEQ ID NO: 112164 - DNA, 25 bp, mus musculus
gacttctcatgtttaggtaccacag

SEQ ID NO: 112165 - DNA, 25 bp, mus musculus
gcaccctgcagcatgaagatcgcag

SEQ ID NO: 112166 - DNA, 25 bp, mus musculus
accctgcagcatgaagatcgcagtc

SEQ ID NO: 112167 - DNA, 25 bp, mus musculus
aacgcgactactctctctgaatcgt

SEQ ID NO: 112168 - DNA, 25 bp, mus musculus
cgcgactactctctctgaatcgttg

SEQ ID NO: 112169 - DNA, 25 bp, mus musculus
cgactactctctctgaatcgttggc

SEQ ID NO: 112170 - DNA, 25 bp, mus musculus
actactctctctgaatcgttggctc

SEQ ID NO: 112171 - DNA, 25 bp, mus musculus
ctctgaatcgttggctccatccggg

SEQ ID NO: 112172 - DNA, 25 bp, mus musculus
ctgaatcgttggctccatccgggct

SEQ ID NO: 112173 - DNA, 25 bp, mus musculus
gaatcgttggctccatccgggcttc

SEQ ID NO: 112174 - DNA, 25 bp, mus musculus
gatcagcacgcagtagtacgacgat

SEQ ID NO: 112175 - DNA, 25 bp, mus musculus
tcagcacgcagtagtacgacgatgc

SEQ ID NO: 112176 - DNA, 25 bp, mus musculus
cagtagtacgacgatgctgggctct

SEQ ID NO: 112177 - DNA, 25 bp, mus musculus
agatcgcagtcattgcacctccgga

SEQ ID NO: 112178 - DNA, 25 bp, mus musculus
atcgcagtcattgcacctccggaac

SEQ ID NO: 112179 - DNA, 25 bp, mus musculus
cgcagtcattgcacctccggaacgc

SEQ ID NO: 112180 - DNA, 25 bp, mus musculus
cagtcattgcacctccggaacgcga

SEQ ID NO: 112181 - DNA, 25 bp, mus musculus
gtcattgcacctccggaacgcgact

SEQ ID NO: 112182 - DNA, 25 bp, mus musculus
cattgcacctccggaacgcgactac

SEQ ID NO: 112183 - DNA, 25 bp, mus musculus
ttgcacctccggaacgcgactactc

SEQ ID NO: 112184 - DNA, 25 bp, mus musculus
ctccggaacgcgactactctctctg

SEQ ID NO: 112185 - DNA, 25 bp, mus musculus
tttgcccttcaaactggtctcccag

SEQ ID NO: 112186 - DNA, 25 bp, mus musculus
tgcccttcaaactggtctcccagaa

SEQ ID NO: 112187 - DNA, 25 bp, mus musculus
agcccagtcgctgtgagtacctcat

SEQ ID NO: 112188 - DNA, 25 bp, mus musculus
cagtcgctgtgagtacctcatggag

SEQ ID NO: 112189 - DNA, 25 bp, mus musculus
gtcgctgtgagtacctcatggagct

SEQ ID NO: 112190 - DNA, 25 bp, mus musculus
cgctgtgagtacctcatggagctga

SEQ ID NO: 112191 - DNA, 25 bp, mus musculus
ctgtgagtacctcatggagctgatg

SEQ ID NO: 112192 - DNA, 25 bp, mus musculus
gagtacctcatggagctgatgacac

SEQ ID NO: 112193 - DNA, 25 bp, mus musculus
gtacctcatggagctgatgacacca

SEQ ID NO: 112194 - DNA, 25 bp, mus musculus
acctcatggagctgatgacaccagc

SEQ ID NO: 112195 - DNA, 25 bp, mus musculus
gctgatgacaccagcagcctgccca

SEQ ID NO: 112196 - DNA, 25 bp, mus musculus
tgatgacaccagcagcctgcccaga

SEQ ID NO: 112197 - DNA, 25 bp, mus musculus
tggtctcccagaaacccaaacatgg

SEQ ID NO: 112198 - DNA, 25 bp, mus musculus
cacatggggctcctgggctggccct

SEQ ID NO: 112199 - DNA, 25 bp, mus musculus
tggccctgatcatgacaagttcagt

SEQ ID NO: 112200 - DNA, 25 bp, mus musculus
tgccctgctgtgtggcaaagagact

SEQ ID NO: 112201 - DNA, 25 bp, mus musculus
ccctgctgtgtggcaaagagactgt

SEQ ID NO: 112202 - DNA, 25 bp, mus musculus
ccacggagcccagtcgctgtgagta

SEQ ID NO: 112203 - DNA, 25 bp, mus musculus
acggagcccagtcgctgtgagtacc

SEQ ID NO: 112204 - DNA, 25 bp, mus musculus
ggagcccagtcgctgtgagtacctc

SEQ ID NO: 112205 - DNA, 25 bp, mus musculus
ctcgtaaatacaagcagctggacac

SEQ ID NO: 112206 - DNA, 25 bp, mus musculus
aatacaagcagctggacaccggcat

SEQ ID NO: 112207 - DNA, 25 bp, mus musculus
atatacctgagtcttgtacataata

SEQ ID NO: 112208 - DNA, 25 bp, mus musculus
aatcaaattttcctagcatgtgcat

SEQ ID NO: 112209 - DNA, 25 bp, mus musculus
attttcctagcatgtgcataattaa

SEQ ID NO: 112210 - DNA, 25 bp, mus musculus
tctaaatgctctggcactgctaact

SEQ ID NO: 112211 - DNA, 25 bp, mus musculus
tgctctggcactgctaactggtaca

SEQ ID NO: 112212 - DNA, 25 bp, mus musculus
ggcactgctaactggtacaaacctg

SEQ ID NO: 112213 - DNA, 25 bp, mus musculus
agggttagcgcttccgaggtagctg

SEQ ID NO: 112214 - DNA, 25 bp, mus musculus
tatctcgtctgccactgactggcct

SEQ ID NO: 112215 - DNA, 25 bp, mus musculus
ttgactatccaacaccctatctgaa

SEQ ID NO: 112216 - DNA, 25 bp, mus musculus
atccaacaccctatctgaaagaaat

SEQ ID NO: 112217 - DNA, 25 bp, mus musculus
agcagctggacaccggcattaccga

SEQ ID NO: 112218 - DNA, 25 bp, mus musculus
gccaggtccagtgtggtactcagaa

SEQ ID NO: 112219 - DNA, 25 bp, mus musculus
ctcagaacttagcctgcaaagttaa

SEQ ID NO: 112220 - DNA, 25 bp, mus musculus
acttagcctgcaaagttaagagagt

SEQ ID NO: 112221 - DNA, 25 bp, mus musculus
gcgtcgcaaacattccaacagtaga

SEQ ID NO: 112222 - DNA, 25 bp, mus musculus
gattaaggctgcccttctatatacc

SEQ ID NO: 112223 - DNA, 25 bp, mus musculus
ggctgcccttctatatacctgagtc

SEQ ID NO: 112224 - DNA, 25 bp, mus musculus
ccttctatatacctgagtcttgtac

SEQ ID NO: 112225 - DNA, 25 bp, mus musculus
ttcctctcagccatgtcctttctct

SEQ ID NO: 112226 - DNA, 25 bp, mus musculus
tctcagccatgtcctttctcttttc

SEQ ID NO: 112227 - DNA, 25 bp, mus musculus
actctttcctgctgtcagatggatt

SEQ ID NO: 112228 - DNA, 25 bp, mus musculus
tctttcctgctgtcagatggatttg

SEQ ID NO: 112229 - DNA, 25 bp, mus musculus
tttcctgctgtcagatggatttggt

SEQ ID NO: 112230 - DNA, 25 bp, mus musculus
tcctgctgtcagatggatttggttg

SEQ ID NO: 112231 - DNA, 25 bp, mus musculus
ctgctgtcagatggatttggttggg

SEQ ID NO: 112232 - DNA, 25 bp, mus musculus
taaatttccctggtgcaattggagc

SEQ ID NO: 112233 - DNA, 25 bp, mus musculus
aatttccctggtgcaattggagcaa

SEQ ID NO: 112234 - DNA, 25 bp, mus musculus
gcaattggagcaaccccaatgtctc

SEQ ID NO: 112235 - DNA, 25 bp, mus musculus
ttggagcaaccccaatgtctccctt

SEQ ID NO: 112236 - DNA, 25 bp, mus musculus
cccaatgtctcccttccagtgtctt

SEQ ID NO: 112237 - DNA, 25 bp, mus musculus
tcttttcctctagaggagttgagct

SEQ ID NO: 112238 - DNA, 25 bp, mus musculus
ttttcctctagaggagttgagctgt

SEQ ID NO: 112239 - DNA, 25 bp, mus musculus
ttgagctgtctaaactccatctgct

SEQ ID NO: 112240 - DNA, 25 bp, mus musculus
tgtctaaactccatctgctgcttcc

SEQ ID NO: 112241 - DNA, 25 bp, mus musculus
tctaaactccatctgctgcttccct

SEQ ID NO: 112242 - DNA, 25 bp, mus musculus
tctcccactctttcctgctgtcaga

SEQ ID NO: 112243 - DNA, 25 bp, mus musculus
tcccactctttcctgctgtcagatg

SEQ ID NO: 112244 - DNA, 25 bp, mus musculus
ccactctttcctgctgtcagatgga

SEQ ID NO: 112245 - DNA, 25 bp, mus musculus
tgctcgactgtaactctcacatgtg

SEQ ID NO: 112246 - DNA, 25 bp, mus musculus
actgtaactctcacatgtgacaaag

SEQ ID NO: 112247 - DNA, 25 bp, mus musculus
gacatgcgcagatgtgagggacacg

SEQ ID NO: 112248 - DNA, 25 bp, mus musculus
agctgagctttcggtctccagaatg

SEQ ID NO: 112249 - DNA, 25 bp, mus musculus
aatctgaactctcaaaagtctattt

SEQ ID NO: 112250 - DNA, 25 bp, mus musculus
tttatacatctattcaggagttgga

SEQ ID NO: 112251 - DNA, 25 bp, mus musculus
atacatctattcaggagttggagtg

SEQ ID NO: 112252 - DNA, 25 bp, mus musculus
gttacctactgagtaggctgcagtt

SEQ ID NO: 112253 - DNA, 25 bp, mus musculus
cacattgaatgcgctctattgccca

SEQ ID NO: 112254 - DNA, 25 bp, mus musculus
gaatgcgctctattgcccatgggat

SEQ ID NO: 112255 - DNA, 25 bp, mus musculus
gctctattgcccatgggatatgtgg

SEQ ID NO: 112256 - DNA, 25 bp, mus musculus
ctattgcccatgggatatgtggtgt

SEQ ID NO: 112257 - DNA, 25 bp, mus musculus
actctcacatgtgacaaagtatggt

SEQ ID NO: 112258 - DNA, 25 bp, mus musculus
ttcacgtcttggtgccttttgtgtg

SEQ ID NO: 112259 - DNA, 25 bp, mus musculus
tgccttttgtgtgacacgccttgcc

SEQ ID NO: 112260 - DNA, 25 bp, mus musculus
tgtgacacgccttgccgatggcttg

SEQ ID NO: 112261 - DNA, 25 bp, mus musculus
gacacgccttgccgatggcttgaca

SEQ ID NO: 112262 - DNA, 25 bp, mus musculus
ccttgccgatggcttgacatgcgca

SEQ ID NO: 112263 - DNA, 25 bp, mus musculus
cgatggcttgacatgcgcagatgtg

SEQ ID NO: 112264 - DNA, 25 bp, mus musculus
cttgacatgcgcagatgtgagggac

SEQ ID NO: 112265 - DNA, 25 bp, mus musculus
taattacactgatgtggctatcttt

SEQ ID NO: 112266 - DNA, 25 bp, mus musculus
ctcagtcctaggttgagtgatggac

SEQ ID NO: 112267 - DNA, 25 bp, mus musculus
aagacattttgtctgcagtacgtaa

SEQ ID NO: 112268 - DNA, 25 bp, mus musculus
ttttgtctgcagtacgtaattgtat

SEQ ID NO: 112269 - DNA, 25 bp, mus musculus
tgtctgcagtacgtaattgtatagt

SEQ ID NO: 112270 - DNA, 25 bp, mus musculus
tagttcagatcctgtgagatgaggt

SEQ ID NO: 112271 - DNA, 25 bp, mus musculus
ttcagatcctgtgagatgaggtgtg

SEQ ID NO: 112272 - DNA, 25 bp, mus musculus
taacgccgaagggtaagctgaactg

SEQ ID NO: 112273 - DNA, 25 bp, mus musculus
gaaaccattggctgagagaaaaatg

SEQ ID NO: 112274 - DNA, 25 bp, mus musculus
gctctttaagtggtggttgttatga

SEQ ID NO: 112275 - DNA, 25 bp, mus musculus
atgaattcacactgataacttgata

SEQ ID NO: 112276 - DNA, 25 bp, mus musculus
aattcacactgataacttgataaag

SEQ ID NO: 112277 - DNA, 25 bp, mus musculus
ctatgttacagttgatgaggattgg

SEQ ID NO: 112278 - DNA, 25 bp, mus musculus
ttttggtgcatcaccattcggtagg

SEQ ID NO: 112279 - DNA, 25 bp, mus musculus
tggtgcatcaccattcggtaggaac

SEQ ID NO: 112280 - DNA, 25 bp, mus musculus
atcaccattcggtaggaacagcggc

SEQ ID NO: 112281 - DNA, 25 bp, mus musculus
taaacttgaaaccttgatctattct

SEQ ID NO: 112282 - DNA, 25 bp, mus musculus
tgaaaccttgatctattctttgtat

SEQ ID NO: 112283 - DNA, 25 bp, mus musculus
aaccttgatctattctttgtatcat

SEQ ID NO: 112284 - DNA, 25 bp, mus musculus
ctattctttgtatcatttaaagcaa

SEQ ID NO: 112285 - DNA, 25 bp, mus musculus
ctgtttggctctgcataggaggagc

SEQ ID NO: 112286 - DNA, 25 bp, mus musculus
tttggctctgcataggaggagctct

SEQ ID NO: 112287 - DNA, 25 bp, mus musculus
gcctggtagccacactccaatcagc

SEQ ID NO: 112288 - DNA, 25 bp, mus musculus
ccacactccaatcagcaggggtcct

SEQ ID NO: 112289 - DNA, 25 bp, mus musculus
cactccaatcagcaggggtccttgg

SEQ ID NO: 112290 - DNA, 25 bp, mus musculus
tccttggactctccacatcaacaaa

SEQ ID NO: 112291 - DNA, 25 bp, mus musculus
ttggactctccacatcaacaaatgc

SEQ ID NO: 112292 - DNA, 25 bp, mus musculus
gactctccacatcaacaaatgccat

SEQ ID NO: 112293 - DNA, 25 bp, mus musculus
ccacatcaacaaatgccatcctagg

SEQ ID NO: 112294 - DNA, 25 bp, mus musculus
catcaacaaatgccatcctaggggc

SEQ ID NO: 112295 - DNA, 25 bp, mus musculus
caacaaatgccatcctaggggctgc

SEQ ID NO: 112296 - DNA, 25 bp, mus musculus
atgccatcctaggggctgctggggc

SEQ ID NO: 112297 - DNA, 25 bp, mus musculus
ctgccatgggcttcactgggacagg

SEQ ID NO: 112298 - DNA, 25 bp, mus musculus
ccatgggcttcactgggacaggcat

SEQ ID NO: 112299 - DNA, 25 bp, mus musculus
tgggcttcactgggacaggcattgc

SEQ ID NO: 112300 - DNA, 25 bp, mus musculus
tcactgggacaggcattgcagctgc

SEQ ID NO: 112301 - DNA, 25 bp, mus musculus
cagctgcctccatagcagccaagat

SEQ ID NO: 112302 - DNA, 25 bp, mus musculus
ccatagcagccaagatgatgtctgc

SEQ ID NO: 112303 - DNA, 25 bp, mus musculus
tgatgtctgctgcagcaattgccaa

SEQ ID NO: 112304 - DNA, 25 bp, mus musculus
ctgctgcagcaattgccaatggagg

SEQ ID NO: 112305 - DNA, 25 bp, mus musculus
tgtttactacacctggacctaatga

SEQ ID NO: 112306 - DNA, 25 bp, mus musculus
ttactacacctggacctaatgatct

SEQ ID NO: 112307 - DNA, 25 bp, mus musculus
atcgcccacatcagcggaaactctt

SEQ ID NO: 112308 - DNA, 25 bp, mus musculus
gcccacatcagcggaaactctttcc

SEQ ID NO: 112309 - DNA, 25 bp, mus musculus
atcagcggaaactctttcccacaag

SEQ ID NO: 112310 - DNA, 25 bp, mus musculus
ttcccacaagtgcgggctatcctca

SEQ ID NO: 112311 - DNA, 25 bp, mus musculus
caagtgcgggctatcctcatcttcg

SEQ ID NO: 112312 - DNA, 25 bp, mus musculus
cgggctatcctcatcttcgaaaaca

SEQ ID NO: 112313 - DNA, 25 bp, mus musculus
gctatcctcatcttcgaaaacatca

SEQ ID NO: 112314 - DNA, 25 bp, mus musculus
atcctcatcttcgaaaacatcagaa

SEQ ID NO: 112315 - DNA, 25 bp, mus musculus
ctcatcttcgaaaacatcagaactg

SEQ ID NO: 112316 - DNA, 25 bp, mus musculus
ttcgaaaacatcagaactggatgga

SEQ ID NO: 112317 - DNA, 25 bp, mus musculus
ctacacctggacctaatgatctgca

SEQ ID NO: 112318 - DNA, 25 bp, mus musculus
cacctggacctaatgatctgcatat

SEQ ID NO: 112319 - DNA, 25 bp, mus musculus
atctgcatatttgatacctgatcag

SEQ ID NO: 112320 - DNA, 25 bp, mus musculus
atatttgatacctgatcagtaggtc

SEQ ID NO: 112321 - DNA, 25 bp, mus musculus
gatacctgatcagtaggtcgagtag

SEQ ID NO: 112322 - DNA, 25 bp, mus musculus
acctgatcagtaggtcgagtagatc

SEQ ID NO: 112323 - DNA, 25 bp, mus musculus
caggtgatcgcccacatcagcggaa

SEQ ID NO: 112324 - DNA, 25 bp, mus musculus
gtgatcgcccacatcagcggaaact

SEQ ID NO: 112325 - DNA, 25 bp, mus musculus
cacttagctctgcacatgaagcgtc

SEQ ID NO: 112326 - DNA, 25 bp, mus musculus
gctctgcacatgaagcgtcacctct

SEQ ID NO: 112327 - DNA, 25 bp, mus musculus
caaacctcacatgtcctcaggagcc

SEQ ID NO: 112328 - DNA, 25 bp, mus musculus
cccacagacccagcaatatagacca

SEQ ID NO: 112329 - DNA, 25 bp, mus musculus
gcaatatagaccaccagataaatca

SEQ ID NO: 112330 - DNA, 25 bp, mus musculus
tagaccaccagataaatcaactcaa

SEQ ID NO: 112331 - DNA, 25 bp, mus musculus
accagataaatcaactcaaatggac

SEQ ID NO: 112332 - DNA, 25 bp, mus musculus
taaatcaactcaaatggacccctag

SEQ ID NO: 112333 - DNA, 25 bp, mus musculus
aatggacccctagaccagaggtgtg

SEQ ID NO: 112334 - DNA, 25 bp, mus musculus
atttcctaagatctagaagggagct

SEQ ID NO: 112335 - DNA, 25 bp, mus musculus
ctgtgcccatccgctaggattgttg

SEQ ID NO: 112336 - DNA, 25 bp, mus musculus
ccatccgctaggattgttgtcgtta

SEQ ID NO: 112337 - DNA, 25 bp, mus musculus
cacatgaagcgtcacctctgagtga

SEQ ID NO: 112338 - DNA, 25 bp, mus musculus
tgagtgatcctgcacaaggactggg

SEQ ID NO: 112339 - DNA, 25 bp, mus musculus
atcctgcacaaggactggggatgaa

SEQ ID NO: 112340 - DNA, 25 bp, mus musculus
tccaaggaccgtatcccaaaagatg

SEQ ID NO: 112341 - DNA, 25 bp, mus musculus
gaccgtatcccaaaagatgagccat

SEQ ID NO: 112342 - DNA, 25 bp, mus musculus
ttatatagtcctacccagatcaaaa

SEQ ID NO: 112343 - DNA, 25 bp, mus musculus
aactgaccagaagaccatacaaagg

SEQ ID NO: 112344 - DNA, 25 bp, mus musculus
tcaggacaaacctcacatgtcctca

SEQ ID NO: 112345 - DNA, 25 bp, mus musculus
tgggtccaggaccttgaaggctcca

SEQ ID NO: 112346 - DNA, 25 bp, mus musculus
gaccttgaaggctccagtgatcaca

SEQ ID NO: 112347 - DNA, 25 bp, mus musculus
gcttttcccaaacatggtcaggaag

SEQ ID NO: 112348 - DNA, 25 bp, mus musculus
tttcccaaacatggtcaggaagata

SEQ ID NO: 112349 - DNA, 25 bp, mus musculus
ttcccaaacatggtcaggaagatag

SEQ ID NO: 112350 - DNA, 25 bp, mus musculus
aagttgatgggccactggcttcttc

SEQ ID NO: 112351 - DNA, 25 bp, mus musculus
ttgatgggccactggcttcttcatc

SEQ ID NO: 112352 - DNA, 25 bp, mus musculus
atgggccactggcttcttcatcata

SEQ ID NO: 112353 - DNA, 25 bp, mus musculus
catcatagcgtcgagttcctattct

SEQ ID NO: 112354 - DNA, 25 bp, mus musculus
tcatagcgtcgagttcctattctca

SEQ ID NO: 112355 - DNA, 25 bp, mus musculus
catagcgtcgagttcctattctcac

SEQ ID NO: 112356 - DNA, 25 bp, mus musculus
tagcgtcgagttcctattctcacat

SEQ ID NO: 112357 - DNA, 25 bp, mus musculus
cttgaaggctccagtgatcacatcc

SEQ ID NO: 112358 - DNA, 25 bp, mus musculus
tgaaggctccagtgatcacatcctc

SEQ ID NO: 112359 - DNA, 25 bp, mus musculus
gaaggctccagtgatcacatcctcc

SEQ ID NO: 112360 - DNA, 25 bp, mus musculus
aggctccagtgatcacatcctccgg

SEQ ID NO: 112361 - DNA, 25 bp, mus musculus
ggctccagtgatcacatcctccggg

SEQ ID NO: 112362 - DNA, 25 bp, mus musculus
ctccagtgatcacatcctccgggtc

SEQ ID NO: 112363 - DNA, 25 bp, mus musculus
tccagtgatcacatcctccgggtcc

SEQ ID NO: 112364 - DNA, 25 bp, mus musculus
taagcttttcccaaacatggtcagg

SEQ ID NO: 112365 - DNA, 25 bp, mus musculus
gggcttcaacgattacctagacatc

SEQ ID NO: 112366 - DNA, 25 bp, mus musculus
catcttctgcccacattatgaaagc

SEQ ID NO: 112367 - DNA, 25 bp, mus musculus
caggctacgaggcctgcacggcaga

SEQ ID NO: 112368 - DNA, 25 bp, mus musculus
ccttccagcgctggaattgctcgat

SEQ ID NO: 112369 - DNA, 25 bp, mus musculus
tccagcgctggaattgctcgatgcc

SEQ ID NO: 112370 - DNA, 25 bp, mus musculus
ggaattgctcgatgccttttgcccc

SEQ ID NO: 112371 - DNA, 25 bp, mus musculus
attgctcgatgccttttgccccttt

SEQ ID NO: 112372 - DNA, 25 bp, mus musculus
tcagccctgttcgattctcagaaaa

SEQ ID NO: 112373 - DNA, 25 bp, mus musculus
ctgttcgattctcagaaaagattca

SEQ ID NO: 112374 - DNA, 25 bp, mus musculus
gctttgagttcttgcctggagagac

SEQ ID NO: 112375 - DNA, 25 bp, mus musculus
agttcttgcctggagagacttacta

SEQ ID NO: 112376 - DNA, 25 bp, mus musculus
actacatctcggtgccgactccgga

SEQ ID NO: 112377 - DNA, 25 bp, mus musculus
cttctgcccacattatgaaagccca

SEQ ID NO: 112378 - DNA, 25 bp, mus musculus
ctgcccacattatgaaagcccaggg

SEQ ID NO: 112379 - DNA, 25 bp, mus musculus
ttatgaaagcccagggccccagaag

SEQ ID NO: 112380 - DNA, 25 bp, mus musculus
ggccgtaaacctttgcattatacat

SEQ ID NO: 112381 - DNA, 25 bp, mus musculus
cctttgcattatacatggtggactg

SEQ ID NO: 112382 - DNA, 25 bp, mus musculus
cattatacatggtggactggtcagg

SEQ ID NO: 112383 - DNA, 25 bp, mus musculus
acatggtggactggtcaggctacga

SEQ ID NO: 112384 - DNA, 25 bp, mus musculus
tggactggtcaggctacgaggcctg

SEQ ID NO: 112385 - DNA, 25 bp, mus musculus
attccagtattgttgtcacaggcgt

SEQ ID NO: 112386 - DNA, 25 bp, mus musculus
gtattgttgtcacaggcgtaaataa

SEQ ID NO: 112387 - DNA, 25 bp, mus musculus
ttcagtggctgccgaagtattcttg

SEQ ID NO: 112388 - DNA, 25 bp, mus musculus
ctgtgtcctggcactgaagccagca

SEQ ID NO: 112389 - DNA, 25 bp, mus musculus
atgagatccatcattcttatgtcag

SEQ ID NO: 112390 - DNA, 25 bp, mus musculus
tccatcattcttatgtcagctcaag

SEQ ID NO: 112391 - DNA, 25 bp, mus musculus
atgtcagctcaagggtcaaaaggac

SEQ ID NO: 112392 - DNA, 25 bp, mus musculus
tcagaatcctgtggcctatcacatg

SEQ ID NO: 112393 - DNA, 25 bp, mus musculus
tcctgtggcctatcacatggcaaaa

SEQ ID NO: 112394 - DNA, 25 bp, mus musculus
ggcctatcacatggcaaaagttatc

SEQ ID NO: 112395 - DNA, 25 bp, mus musculus
tatatctgcagcccacttattttca

SEQ ID NO: 112396 - DNA, 25 bp, mus musculus
tgcagcccacttattttcaaaatga

SEQ ID NO: 112397 - DNA, 25 bp, mus musculus
atatttatcagcagttttgagcaaa

SEQ ID NO: 112398 - DNA, 25 bp, mus musculus
cagaattgccatattctcaggttat

SEQ ID NO: 112399 - DNA, 25 bp, mus musculus
tgccatattctcaggttatggccta

SEQ ID NO: 112400 - DNA, 25 bp, mus musculus
aggttatggcctaggagtgtcatta

SEQ ID NO: 112401 - DNA, 25 bp, mus musculus
gtcattacgggtacaaggtgcagtt

SEQ ID NO: 112402 - DNA, 25 bp, mus musculus
tgcagttcctggtgaatataacatg

SEQ ID NO: 112403 - DNA, 25 bp, mus musculus
acatattggctttatcccatgggat

SEQ ID NO: 112404 - DNA, 25 bp, mus musculus
tatcccatgggattcagtggctgcc

SEQ ID NO: 112405 - DNA, 25 bp, mus musculus
gttaagcagcatcttctccaaaatg

SEQ ID NO: 112406 - DNA, 25 bp, mus musculus
aagcagcatcttctccaaaatgttt

SEQ ID NO: 112407 - DNA, 25 bp, mus musculus
gcgtaacctgtatgcactctgtaat

SEQ ID NO: 112408 - DNA, 25 bp, mus musculus
taacctgtatgcactctgtaatggg

SEQ ID NO: 112409 - DNA, 25 bp, mus musculus
cctgtatgcactctgtaatgggctt

SEQ ID NO: 112410 - DNA, 25 bp, mus musculus
gtatgcactctgtaatgggctttaa

SEQ ID NO: 112411 - DNA, 25 bp, mus musculus
actctgtaatgggctttaagatggg

SEQ ID NO: 112412 - DNA, 25 bp, mus musculus
tttccatagactttcccacagccac

SEQ ID NO: 112413 - DNA, 25 bp, mus musculus
ttcccacagccactgtaggggcact

SEQ ID NO: 112414 - DNA, 25 bp, mus musculus
ccacagccactgtaggggcacttgt

SEQ ID NO: 112415 - DNA, 25 bp, mus musculus
cagccactgtaggggcacttgtgct

SEQ ID NO: 112416 - DNA, 25 bp, mus musculus
ccactgtaggggcacttgtgctcgt

SEQ ID NO: 112417 - DNA, 25 bp, mus musculus
cagcatcttctccaaaatgtttgca

SEQ ID NO: 112418 - DNA, 25 bp, mus musculus
catcttctccaaaatgtttgcagcc

SEQ ID NO: 112419 - DNA, 25 bp, mus musculus
aatgtttgcagcctctaggccgagt

SEQ ID NO: 112420 - DNA, 25 bp, mus musculus
gtttgcagcctctaggccgagtgcg

SEQ ID NO: 112421 - DNA, 25 bp, mus musculus
agcctctaggccgagtgcggtgtcc

SEQ ID NO: 112422 - DNA, 25 bp, mus musculus
ctctaggccgagtgcggtgtcctgg

SEQ ID NO: 112423 - DNA, 25 bp, mus musculus
aggcgacgcgcgtaacctgtatgca

SEQ ID NO: 112424 - DNA, 25 bp, mus musculus
cgacgcgcgtaacctgtatgcactc

SEQ ID NO: 112425 - DNA, 25 bp, mus musculus
tggctcagaagaaccgcgaggaact

SEQ ID NO: 112426 - DNA, 25 bp, mus musculus
agtactggtctcagcagattgagga

SEQ ID NO: 112427 - DNA, 25 bp, mus musculus
atggggtccttctgcatctggagtc

SEQ ID NO: 112428 - DNA, 25 bp, mus musculus
tccttctgcatctggagtcagagct

SEQ ID NO: 112429 - DNA, 25 bp, mus musculus
agcgccaggcccaggaatatgaagc

SEQ ID NO: 112430 - DNA, 25 bp, mus musculus
gtctcaacgatgccctggactccag

SEQ ID NO: 112431 - DNA, 25 bp, mus musculus
gcaactccatgcaaactgtgcagaa

SEQ ID NO: 112432 - DNA, 25 bp, mus musculus
ccatgcaaactgtgcagaagacaac

SEQ ID NO: 112433 - DNA, 25 bp, mus musculus
tgcagaagacaactacccgtaagat

SEQ ID NO: 112434 - DNA, 25 bp, mus musculus
ctacccgtaagatcgtggatggcag

SEQ ID NO: 112435 - DNA, 25 bp, mus musculus
agactaatgacaccagagttctgag

SEQ ID NO: 112436 - DNA, 25 bp, mus musculus
ttctgaggcactgaggcagagaagg

SEQ ID NO: 112437 - DNA, 25 bp, mus musculus
ggtctcagcagattgaggagagtac

SEQ ID NO: 112438 - DNA, 25 bp, mus musculus
ccacagttgtcaccaccaagtctgc

SEQ ID NO: 112439 - DNA, 25 bp, mus musculus
ttgtcaccaccaagtctgccgaaat

SEQ ID NO: 112440 - DNA, 25 bp, mus musculus
agtctgccgaaatcagggacgctga

SEQ ID NO: 112441 - DNA, 25 bp, mus musculus
agattgacttggactccatgaaaaa

SEQ ID NO: 112442 - DNA, 25 bp, mus musculus
accagaacatcaacttggagaacag

SEQ ID NO: 112443 - DNA, 25 bp, mus musculus
cccgatacaaggcacagatggagca

SEQ ID NO: 112444 - DNA, 25 bp, mus musculus
agctcaatggggtccttctgcatct

SEQ ID NO: 112445 - DNA, 25 bp, mus musculus
cctactggcatggctgctactcctg

SEQ ID NO: 112446 - DNA, 25 bp, mus musculus
ctactggcatggctgctactcctgt

SEQ ID NO: 112447 - DNA, 25 bp, mus musculus
tcggactctggcactgcccaagttg

SEQ ID NO: 112448 - DNA, 25 bp, mus musculus
cggactctggcactgcccaagttgc

SEQ ID NO: 112449 - DNA, 25 bp, mus musculus
gactctggcactgcccaagttgccc

SEQ ID NO: 112450 - DNA, 25 bp, mus musculus
cccagagcctgggcctggacagcct

SEQ ID NO: 112451 - DNA, 25 bp, mus musculus
cagagcctgggcctggacagcctgg

SEQ ID NO: 112452 - DNA, 25 bp, mus musculus
tggcccttccacagctgccacagga

SEQ ID NO: 112453 - DNA, 25 bp, mus musculus
cagctgccacaggaggtttaggggc

SEQ ID NO: 112454 - DNA, 25 bp, mus musculus
tactggcatggctgctactcctgtc

SEQ ID NO: 112455 - DNA, 25 bp, mus musculus
actggcatggctgctactcctgtcc

SEQ ID NO: 112456 - DNA, 25 bp, mus musculus
ctctccaggctcggactctggcact

SEQ ID NO: 112457 - DNA, 25 bp, mus musculus
ctccaggctcggactctggcactgc

SEQ ID NO: 112458 - DNA, 25 bp, mus musculus
tccaggctcggactctggcactgcc

SEQ ID NO: 112459 - DNA, 25 bp, mus musculus
caggctcggactctggcactgccca

SEQ ID NO: 112460 - DNA, 25 bp, mus musculus
aggctcggactctggcactgcccaa

SEQ ID NO: 112461 - DNA, 25 bp, mus musculus
ctcggactctggcactgcccaagtt

SEQ ID NO: 112462 - DNA, 25 bp, mus musculus
gtacaagaacttctacacctgaacg

SEQ ID NO: 112463 - DNA, 25 bp, mus musculus
acaagaacttctacacctgaacgca

SEQ ID NO: 112464 - DNA, 25 bp, mus musculus
tacaagtcgctgacaggaatcgagt

SEQ ID NO: 112465 - DNA, 25 bp, mus musculus
agtcgctgacaggaatcgagtataa

SEQ ID NO: 112466 - DNA, 25 bp, mus musculus
agtataagcctgtgtctgctactga

SEQ ID NO: 112467 - DNA, 25 bp, mus musculus
tataagcctgtgtctgctactgatc

SEQ ID NO: 112468 - DNA, 25 bp, mus musculus
taagcctgtgtctgctactgatcgc

SEQ ID NO: 112469 - DNA, 25 bp, mus musculus
agcctgtgtctgctactgatcgcag

SEQ ID NO: 112470 - DNA, 25 bp, mus musculus
tgtgtctgctactgatcgcagaaga

SEQ ID NO: 112471 - DNA, 25 bp, mus musculus
tctgctactgatcgcagaagacaaa

SEQ ID NO: 112472 - DNA, 25 bp, mus musculus
tgctactgatcgcagaagacaaaga

SEQ ID NO: 112473 - DNA, 25 bp, mus musculus
ctactgatcgcagaagacaaagata

SEQ ID NO: 112474 - DNA, 25 bp, mus musculus
gaacttctacacctgaacgcacagt

SEQ ID NO: 112475 - DNA, 25 bp, mus musculus
acttctacacctgaacgcacagtac

SEQ ID NO: 112476 - DNA, 25 bp, mus musculus
ttctacacctgaacgcacagtacaa

SEQ ID NO: 112477 - DNA, 25 bp, mus musculus
ctacacctgaacgcacagtacaagt

SEQ ID NO: 112478 - DNA, 25 bp, mus musculus
acacctgaacgcacagtacaagtcg

SEQ ID NO: 112479 - DNA, 25 bp, mus musculus
acgcacagtacaagtcgctgacagg

SEQ ID NO: 112480 - DNA, 25 bp, mus musculus
acagtacaagtcgctgacaggaatc

SEQ ID NO: 112481 - DNA, 25 bp, mus musculus
agtacaagtcgctgacaggaatcga

SEQ ID NO: 112482 - DNA, 25 bp, mus musculus
agcaccaacaatgacgaagacatga

SEQ ID NO: 112483 - DNA, 25 bp, mus musculus
gagtctctgccctctgatgaagaag

SEQ ID NO: 112484 - DNA, 25 bp, mus musculus
tgcccccgtggtctagataactaca

SEQ ID NO: 112485 - DNA, 25 bp, mus musculus
ctagataactacactgcctgaaagc

SEQ ID NO: 112486 - DNA, 25 bp, mus musculus
gataactacactgcctgaaagctgt

SEQ ID NO: 112487 - DNA, 25 bp, mus musculus
actgcctgaaagctgtgattttagg

SEQ ID NO: 112488 - DNA, 25 bp, mus musculus
tcttgaagctcagtattggtctctt

SEQ ID NO: 112489 - DNA, 25 bp, mus musculus
agctcagtattggtctcttatggct

SEQ ID NO: 112490 - DNA, 25 bp, mus musculus
tcagtattggtctcttatggctatg

SEQ ID NO: 112491 - DNA, 25 bp, mus musculus
gtctcttatggctatgttgttatca

SEQ ID NO: 112492 - DNA, 25 bp, mus musculus
cctcatctctcctggatgaaacatc

SEQ ID NO: 112493 - DNA, 25 bp, mus musculus
ctctcctggatgaaacatcaataaa

SEQ ID NO: 112494 - DNA, 25 bp, mus musculus
ggctttatgcggttctgaagccctt

SEQ ID NO: 112495 - DNA, 25 bp, mus musculus
ttctgaagcccttttccagcagtga

SEQ ID NO: 112496 - DNA, 25 bp, mus musculus
ccatgagcaactgccttgtcaatga

SEQ ID NO: 112497 - DNA, 25 bp, mus musculus
gcaactgccttgtcaatgatgtttc

SEQ ID NO: 112498 - DNA, 25 bp, mus musculus
tttcttgtcacatgctgctttgtgc

SEQ ID NO: 112499 - DNA, 25 bp, mus musculus
acatgctgctttgtgctgtacagtt

SEQ ID NO: 112500 - DNA, 25 bp, mus musculus
ctgtacagttgcccccgtggtctag

SEQ ID NO: 112501 - DNA, 25 bp, mus musculus
tacagttgcccccgtggtctagata

SEQ ID NO: 112502 - DNA, 25 bp, mus musculus
tgagtcacaggtcagcaggatgcca

SEQ ID NO: 112503 - DNA, 25 bp, mus musculus
acaggtcagcaggatgccaggagta

SEQ ID NO: 112504 - DNA, 25 bp, mus musculus
agcactgtcaattctgctacctctg

SEQ ID NO: 112505 - DNA, 25 bp, mus musculus
actgtcaattctgctacctctgtcc

SEQ ID NO: 112506 - DNA, 25 bp, mus musculus
aattctgctacctctgtccgctggt

SEQ ID NO: 112507 - DNA, 25 bp, mus musculus
tctgctacctctgtccgctggtgtg

SEQ ID NO: 112508 - DNA, 25 bp, mus musculus
tctgtccgctggtgtgtgacacgct

SEQ ID NO: 112509 - DNA, 25 bp, mus musculus
tgtgtgacacgctctgcactccagg

SEQ ID NO: 112510 - DNA, 25 bp, mus musculus
gtgacacgctctgcactccaggaag

SEQ ID NO: 112511 - DNA, 25 bp, mus musculus
acacgctctgcactccaggaagcta

SEQ ID NO: 112512 - DNA, 25 bp, mus musculus
tctgcactccaggaagctacgttga

SEQ ID NO: 112513 - DNA, 25 bp, mus musculus
gcactccaggaagctacgttgacta

SEQ ID NO: 112514 - DNA, 25 bp, mus musculus
gctactgttctttctgcaaccgatg

SEQ ID NO: 112515 - DNA, 25 bp, mus musculus
actgttctttctgcaaccgatgtac

SEQ ID NO: 112516 - DNA, 25 bp, mus musculus
tctgcaaccgatgtaccgaatgtga

SEQ ID NO: 112517 - DNA, 25 bp, mus musculus
gcaaccgatgtaccgaatgtgaaag

SEQ ID NO: 112518 - DNA, 25 bp, mus musculus
aaagctgtcactgtgatgaggagaa

SEQ ID NO: 112519 - DNA, 25 bp, mus musculus
actgtgaccagtgtcagcactgtca

SEQ ID NO: 112520 - DNA, 25 bp, mus musculus
gtgaccagtgtcagcactgtcaatt

SEQ ID NO: 112521 - DNA, 25 bp, mus musculus
accagtgtcagcactgtcaattctg

SEQ ID NO: 112522 - DNA, 25 bp, mus musculus
ccatgataaccagacctgttgtaaa

SEQ ID NO: 112523 - DNA, 25 bp, mus musculus
tgataaccagacctgttgtaaagac

SEQ ID NO: 112524 - DNA, 25 bp, mus musculus
catcctgagtcaccctatcaccatg

SEQ ID NO: 112525 - DNA, 25 bp, mus musculus
cctgagtcaccctatcaccatggga

SEQ ID NO: 112526 - DNA, 25 bp, mus musculus
gagtcaccctatcaccatgggaggt

SEQ ID NO: 112527 - DNA, 25 bp, mus musculus
tggcaaaagccccgtatcaaactgc

SEQ ID NO: 112528 - DNA, 25 bp, mus musculus
cgtatcaaactgccatttcttccgg

SEQ ID NO: 112529 - DNA, 25 bp, mus musculus
ctgccatttcttccggtttctgtgg

SEQ ID NO: 112530 - DNA, 25 bp, mus musculus
gtggaccttgtggccaggtgctctt

SEQ ID NO: 112531 - DNA, 25 bp, mus musculus
gaccttgtggccaggtgctcttccc

SEQ ID NO: 112532 - DNA, 25 bp, mus musculus
cttgtggccaggtgctcttcccgag

SEQ ID NO: 112533 - DNA, 25 bp, mus musculus
cgagccacaggtgttctgtgagctt

SEQ ID NO: 112534 - DNA, 25 bp, mus musculus
taaccagacctgttgtaaagacagt

SEQ ID NO: 112535 - DNA, 25 bp, mus musculus
agacagtgcaggagtctgggcctgc

SEQ ID NO: 112536 - DNA, 25 bp, mus musculus
tccctacctaaagggtgtctgctgt

SEQ ID NO: 112537 - DNA, 25 bp, mus musculus
tcactgttgccccggtggcttccac

SEQ ID NO: 112538 - DNA, 25 bp, mus musculus
ttgccccggtggcttccactgttca

SEQ ID NO: 112539 - DNA, 25 bp, mus musculus
ccactgttcagccaggggaaccaag

SEQ ID NO: 112540 - DNA, 25 bp, mus musculus
gattcctcgctgggacatgtttttg

SEQ ID NO: 112541 - DNA, 25 bp, mus musculus
gaactccacagtcctgggaaccctg

SEQ ID NO: 112542 - DNA, 25 bp, mus musculus
tgaccctgccaggcacatcagtggg

SEQ ID NO: 112543 - DNA, 25 bp, mus musculus
gtacaagaacttcatccagaactat

SEQ ID NO: 112544 - DNA, 25 bp, mus musculus
taaacttgcacaatctaatggctgg

SEQ ID NO: 112545 - DNA, 25 bp, mus musculus
gaccgaagacactttcatcgctgac

SEQ ID NO: 112546 - DNA, 25 bp, mus musculus
agacactttcatcgctgaccttgtg

SEQ ID NO: 112547 - DNA, 25 bp, mus musculus
ctgccgttcagagcgtctggcaaaa

SEQ ID NO: 112548 - DNA, 25 bp, mus musculus
ccgttcagagcgtctggcaaaatac

SEQ ID NO: 112549 - DNA, 25 bp, mus musculus
ggacaaagctgtctttgctggaaga

SEQ ID NO: 112550 - DNA, 25 bp, mus musculus
caaagctgtctttgctggaagaaag

SEQ ID NO: 112551 - DNA, 25 bp, mus musculus
taatccaaaggccaaatgaggagct

SEQ ID NO: 112552 - DNA, 25 bp, mus musculus
ctccaggctttcacaggaaagacac

SEQ ID NO: 112553 - DNA, 25 bp, mus musculus
aagacacaggccttcaagcccttct

SEQ ID NO: 112554 - DNA, 25 bp, mus musculus
gaacttcatccagaactatcccgtg

SEQ ID NO: 112555 - DNA, 25 bp, mus musculus
catccagaactatcccgtggtctcc

SEQ ID NO: 112556 - DNA, 25 bp, mus musculus
ctttgaccaggatgactgggccaca

SEQ ID NO: 112557 - DNA, 25 bp, mus musculus
gattgctcaggctgtggagaagaag

SEQ ID NO: 112558 - DNA, 25 bp, mus musculus
caattgcctgctcctgaaggtcaac

SEQ ID NO: 112559 - DNA, 25 bp, mus musculus
ttgcctgctcctgaaggtcaaccag

SEQ ID NO: 112560 - DNA, 25 bp, mus musculus
cctgctcctgaaggtcaaccagatc

SEQ ID NO: 112561 - DNA, 25 bp, mus musculus
catccaggcctgtaaacttgcacaa

SEQ ID NO: 112562 - DNA, 25 bp, mus musculus
gcccctctaccagttagcccagaag

SEQ ID NO: 112563 - DNA, 25 bp, mus musculus
ctctaccagttagcccagaagaagc

SEQ ID NO: 112564 - DNA, 25 bp, mus musculus
ccctaggccacctcatgggtgtgct

SEQ ID NO: 112565 - DNA, 25 bp, mus musculus
aggccacctcatgggtgtgctgagg

SEQ ID NO: 112566 - DNA, 25 bp, mus musculus
ggagttcttcaccaagctgggtcta

SEQ ID NO: 112567 - DNA, 25 bp, mus musculus
ttcttcaccaagctgggtctaaaga

SEQ ID NO: 112568 - DNA, 25 bp, mus musculus
cttcaccaagctgggtctaaagaag

SEQ ID NO: 112569 - DNA, 25 bp, mus musculus
tgaagttggcaactctggggtcttc

SEQ ID NO: 112570 - DNA, 25 bp, mus musculus
ccgccctgagatgctcctgcctatg

SEQ ID NO: 112571 - DNA, 25 bp, mus musculus
gctcctgcctatggggctccctgag

SEQ ID NO: 112572 - DNA, 25 bp, mus musculus
tcctgcctatggggctccctgagaa

SEQ ID NO: 112573 - DNA, 25 bp, mus musculus
ctgcctatggggctccctgagaatg

SEQ ID NO: 112574 - DNA, 25 bp, mus musculus
ctaccagttagcccagaagaagccg

SEQ ID NO: 112575 - DNA, 25 bp, mus musculus
gtttacaccagccaagtacttctct

SEQ ID NO: 112576 - DNA, 25 bp, mus musculus
acaccagccaagtacttctctattg

SEQ ID NO: 112577 - DNA, 25 bp, mus musculus
accagccaagtacttctctattgat

SEQ ID NO: 112578 - DNA, 25 bp, mus musculus
cagccaagtacttctctattgatcg

SEQ ID NO: 112579 - DNA, 25 bp, mus musculus
atgagacgctggacgccacgcacct

SEQ ID NO: 112580 - DNA, 25 bp, mus musculus
agttccaccagattgagggtgtaat

SEQ ID NO: 112581 - DNA, 25 bp, mus musculus
ttccaccagattgagggtgtaatag

SEQ ID NO: 112582 - DNA, 25 bp, mus musculus
gcagatatccggtacgcctacaccc

SEQ ID NO: 112583 - DNA, 25 bp, mus musculus
tacaccccagtcatggaaagcctct

SEQ ID NO: 112584 - DNA, 25 bp, mus musculus
ttatctatcccttgcaaactggaga

SEQ ID NO: 112585 - DNA, 25 bp, mus musculus
atcccttgcaaactggagagtgaca

SEQ ID NO: 112586 - DNA, 25 bp, mus musculus
gactaccagagccgtcactttgctt

SEQ ID NO: 112587 - DNA, 25 bp, mus musculus
cgtcactttgcttgcctgccacgga

SEQ ID NO: 112588 - DNA, 25 bp, mus musculus
tttgcttgcctgccacggaatctag

SEQ ID NO: 112589 - DNA, 25 bp, mus musculus
ccacggaatctaggcttgtgcactt

SEQ ID NO: 112590 - DNA, 25 bp, mus musculus
tgcacttggagatcccttggggccc

SEQ ID NO: 112591 - DNA, 25 bp, mus musculus
ctgaagcctgaacactgtctacttt

SEQ ID NO: 112592 - DNA, 25 bp, mus musculus
catctttctttctcttagatggtga

SEQ ID NO: 112593 - DNA, 25 bp, mus musculus
tctttctcttagatggtgaaataaa

SEQ ID NO: 112594 - DNA, 25 bp, mus musculus
cacaagtcccagaaccgcagtgaag

SEQ ID NO: 112595 - DNA, 25 bp, mus musculus
tcccagaaccgcagtgaagagtttc

SEQ ID NO: 112596 - DNA, 25 bp, mus musculus
gagtttctcatcacgggccgcctaa

SEQ ID NO: 112597 - DNA, 25 bp, mus musculus
ctcatcacgggccgcctaaggaacg

SEQ ID NO: 112598 - DNA, 25 bp, mus musculus
tttcacatcaatgcctgcagcttct

SEQ ID NO: 112599 - DNA, 25 bp, mus musculus
atcaatgcctgcagcttcttggttc

SEQ ID NO: 112600 - DNA, 25 bp, mus musculus
cgtactctgagccctgctcagcaaa

SEQ ID NO: 112601 - DNA, 25 bp, mus musculus
ctgagccctgctcagcaaagagttt

SEQ ID NO: 112602 - DNA, 25 bp, mus musculus
acacccctgctacagtccattgtgg

SEQ ID NO: 112603 - DNA, 25 bp, mus musculus
cacccctgctacagtccattgtggt

SEQ ID NO: 112604 - DNA, 25 bp, mus musculus
gatttatccactgacccagttcttg

SEQ ID NO: 112605 - DNA, 25 bp, mus musculus
atttatccactgacccagttcttgc

SEQ ID NO: 112606 - DNA, 25 bp, mus musculus
tttatccactgacccagttcttgcc

SEQ ID NO: 112607 - DNA, 25 bp, mus musculus
tcacttccaaggaacgatgagaggt

SEQ ID NO: 112608 - DNA, 25 bp, mus musculus
cacttccaaggaacgatgagaggtt

SEQ ID NO: 112609 - DNA, 25 bp, mus musculus
agaggttctctcagctgcctggagt

SEQ ID NO: 112610 - DNA, 25 bp, mus musculus
gaggttctctcagctgcctggagtc

SEQ ID NO: 112611 - DNA, 25 bp, mus musculus
acccctgctacagtccattgtggtg

SEQ ID NO: 112612 - DNA, 25 bp, mus musculus
cccctgctacagtccattgtggtgg

SEQ ID NO: 112613 - DNA, 25 bp, mus musculus
tcccacgctctctggatttatccac

SEQ ID NO: 112614 - DNA, 25 bp, mus musculus
cccacgctctctggatttatccact

SEQ ID NO: 112615 - DNA, 25 bp, mus musculus
ccacgctctctggatttatccactg

SEQ ID NO: 112616 - DNA, 25 bp, mus musculus
cacgctctctggatttatccactga

SEQ ID NO: 112617 - DNA, 25 bp, mus musculus
tggatttatccactgacccagttct

SEQ ID NO: 112618 - DNA, 25 bp, mus musculus
ggatttatccactgacccagttctt

SEQ ID NO: 112619 - DNA, 25 bp, mus musculus
tccaagatctgagcagggtgccaga

SEQ ID NO: 112620 - DNA, 25 bp, mus musculus
agatctgagcagggtgccagaacag

SEQ ID NO: 112621 - DNA, 25 bp, mus musculus
agtacatgttccagaaggatgaata

SEQ ID NO: 112622 - DNA, 25 bp, mus musculus
tacatgttccagaaggatgaatact

SEQ ID NO: 112623 - DNA, 25 bp, mus musculus
actgcatcctgatcctgggcctgga

SEQ ID NO: 112624 - DNA, 25 bp, mus musculus
tgcatcctgatcctgggcctggaca

SEQ ID NO: 112625 - DNA, 25 bp, mus musculus
tcctgatcctgggcctggacaatgc

SEQ ID NO: 112626 - DNA, 25 bp, mus musculus
ctgatcctgggcctggacaatgctg

SEQ ID NO: 112627 - DNA, 25 bp, mus musculus
gatcctgggcctggacaatgctggg

SEQ ID NO: 112628 - DNA, 25 bp, mus musculus
tgagtctatccaaaatcaccactac

SEQ ID NO: 112629 - DNA, 25 bp, mus musculus
agtctatccaaaatcaccactaccg

SEQ ID NO: 112630 - DNA, 25 bp, mus musculus
gtctaaacattggcactgtggacgt

SEQ ID NO: 112631 - DNA, 25 bp, mus musculus
ggatgtacacgctgctttcgggatt

SEQ ID NO: 112632 - DNA, 25 bp, mus musculus
atgtacacgctgctttcgggattgt

SEQ ID NO: 112633 - DNA, 25 bp, mus musculus
gtacacgctgctttcgggattgtac

SEQ ID NO: 112634 - DNA, 25 bp, mus musculus
acacgctgctttcgggattgtacaa

SEQ ID NO: 112635 - DNA, 25 bp, mus musculus
gctgctttcgggattgtacaagtac

SEQ ID NO: 112636 - DNA, 25 bp, mus musculus
tgctttcgggattgtacaagtacat

SEQ ID NO: 112637 - DNA, 25 bp, mus musculus
tgtacaagtacatgttccagaagga

SEQ ID NO: 112638 - DNA, 25 bp, mus musculus
tacaagtacatgttccagaaggatg

SEQ ID NO: 112639 - DNA, 25 bp, mus musculus
ctccgtcctgaaatgtccaagaaca

SEQ ID NO: 112640 - DNA, 25 bp, mus musculus
aaccagattctcatcaagtggctgc

SEQ ID NO: 112641 - DNA, 25 bp, mus musculus
accagcatcgttcttttgccagcca

SEQ ID NO: 112642 - DNA, 25 bp, mus musculus
atcgttcttttgccagccagtgatt

SEQ ID NO: 112643 - DNA, 25 bp, mus musculus
tcttttgagtatgcctgtgccatca

SEQ ID NO: 112644 - DNA, 25 bp, mus musculus
gagtatgcctgtgccatcagagaag

SEQ ID NO: 112645 - DNA, 25 bp, mus musculus
gcctgtgccatcagagaagagatcc

SEQ ID NO: 112646 - DNA, 25 bp, mus musculus
tgcaaccaaacccaagcctgctctt

SEQ ID NO: 112647 - DNA, 25 bp, mus musculus
caagcctgctctttttgaagcagct

SEQ ID NO: 112648 - DNA, 25 bp, mus musculus
tgctctttttgaagcagctgattgg

SEQ ID NO: 112649 - DNA, 25 bp, mus musculus
ttttgaagcagctgattggagagta

SEQ ID NO: 112650 - DNA, 25 bp, mus musculus
tcaataaagctaaacctcagggctc

SEQ ID NO: 112651 - DNA, 25 bp, mus musculus
attctcatcaagtggctgcagactg

SEQ ID NO: 112652 - DNA, 25 bp, mus musculus
cagaacccatcagtgacctccaaga

SEQ ID NO: 112653 - DNA, 25 bp, mus musculus
ccatcagtgacctccaagatttagc

SEQ ID NO: 112654 - DNA, 25 bp, mus musculus
gtgacctccaagatttagccactgg

SEQ ID NO: 112655 - DNA, 25 bp, mus musculus
tccaagatttagccactggggacac

SEQ ID NO: 112656 - DNA, 25 bp, mus musculus
agtttctggaacacagcctgatcta

SEQ ID NO: 112657 - DNA, 25 bp, mus musculus
tggaacacagcctgatctacaagta

SEQ ID NO: 112658 - DNA, 25 bp, mus musculus
acagcctgatctacaagtaccagca

SEQ ID NO: 112659 - DNA, 25 bp, mus musculus
gagagctgccatctcatacagcagg

SEQ ID NO: 112660 - DNA, 25 bp, mus musculus
agctgccatctcatacagcaggcag

SEQ ID NO: 112661 - DNA, 25 bp, mus musculus
gtatggtgttcccactagtgagtgg

SEQ ID NO: 112662 - DNA, 25 bp, mus musculus
tggtgttcccactagtgagtgggcc

SEQ ID NO: 112663 - DNA, 25 bp, mus musculus
cgcagtggtctccgagctgaagaag

SEQ ID NO: 112664 - DNA, 25 bp, mus musculus
ggtctccgagctgaagaagcggccc

SEQ ID NO: 112665 - DNA, 25 bp, mus musculus
gtcaccaagcttcacaatgcccgta

SEQ ID NO: 112666 - DNA, 25 bp, mus musculus
aagcttcacaatgcccgtagctgtg

SEQ ID NO: 112667 - DNA, 25 bp, mus musculus
cttcacaatgcccgtagctgtgatg

SEQ ID NO: 112668 - DNA, 25 bp, mus musculus
cacaatgcccgtagctgtgatgaac

SEQ ID NO: 112669 - DNA, 25 bp, mus musculus
aatgcccgtagctgtgatgaacacg

SEQ ID NO: 112670 - DNA, 25 bp, mus musculus
tgtgatgaacacgttggcgggcttg

SEQ ID NO: 112671 - DNA, 25 bp, mus musculus
tgccatctcatacagcaggcagcct

SEQ ID NO: 112672 - DNA, 25 bp, mus musculus
cttgatgtctcggtgcatcacacgt

SEQ ID NO: 112673 - DNA, 25 bp, mus musculus
catctcatacagcaggcagcctagg

SEQ ID NO: 112674 - DNA, 25 bp, mus musculus
atacagcaggcagcctagggaccag

SEQ ID NO: 112675 - DNA, 25 bp, mus musculus
caggcagcctagggaccagatgtct

SEQ ID NO: 112676 - DNA, 25 bp, mus musculus
gccattctcatggattctctcgggt

SEQ ID NO: 112677 - DNA, 25 bp, mus musculus
attctcatggattctctcgggtgac

SEQ ID NO: 112678 - DNA, 25 bp, mus musculus
ctcatggattctctcgggtgacatg

SEQ ID NO: 112679 - DNA, 25 bp, mus musculus
atggattctctcgggtgacatgtag

SEQ ID NO: 112680 - DNA, 25 bp, mus musculus
gttgcacccaggcgtgttggcgagc

SEQ ID NO: 112681 - DNA, 25 bp, mus musculus
ttgcacccaggcgtgttggcgagcc

SEQ ID NO: 112682 - DNA, 25 bp, mus musculus
aatttgattcccagctcttccacac

SEQ ID NO: 112683 - DNA, 25 bp, mus musculus
tttgattcccagctcttccacacaa

SEQ ID NO: 112684 - DNA, 25 bp, mus musculus
ttgattcccagctcttccacacaat

SEQ ID NO: 112685 - DNA, 25 bp, mus musculus
tgattcccagctcttccacacaata

SEQ ID NO: 112686 - DNA, 25 bp, mus musculus
ccagctcttccacacaataggtgtg

SEQ ID NO: 112687 - DNA, 25 bp, mus musculus
cagctcttccacacaataggtgtgg

SEQ ID NO: 112688 - DNA, 25 bp, mus musculus
agctcttccacacaataggtgtgga

SEQ ID NO: 112689 - DNA, 25 bp, mus musculus
ctcttccacacaataggtgtggaat

SEQ ID NO: 112690 - DNA, 25 bp, mus musculus
tcttccacacaataggtgtggaatt

SEQ ID NO: 112691 - DNA, 25 bp, mus musculus
cttccacacaataggtgtggaattt

SEQ ID NO: 112692 - DNA, 25 bp, mus musculus
cgtccagtgtgtgtctgcaagataa

SEQ ID NO: 112693 - DNA, 25 bp, mus musculus
gtccagtgtgtgtctgcaagataat

SEQ ID NO: 112694 - DNA, 25 bp, mus musculus
aattcttcttggagatggtggagtt

SEQ ID NO: 112695 - DNA, 25 bp, mus musculus
attcttcttggagatggtggagttg

SEQ ID NO: 112696 - DNA, 25 bp, mus musculus
agagttctcttatgaacagatatgt

SEQ ID NO: 112697 - DNA, 25 bp, mus musculus
ttctcttatgaacagatatgtaacc

SEQ ID NO: 112698 - DNA, 25 bp, mus musculus
taaatttgattcccagctcttccac

SEQ ID NO: 112699 - DNA, 25 bp, mus musculus
aaatttgattcccagctcttccaca

SEQ ID NO: 112700 - DNA, 25 bp, mus musculus
cagtcctgttgaaaacccattgtcg

SEQ ID NO: 112701 - DNA, 25 bp, mus musculus
tcctgttgaaaacccattgtcggat

SEQ ID NO: 112702 - DNA, 25 bp, mus musculus
atctctcaagcagcaaagtttgatc

SEQ ID NO: 112703 - DNA, 25 bp, mus musculus
gatccttcttcgaaaatctatgaaa

SEQ ID NO: 112704 - DNA, 25 bp, mus musculus
ccttcttcgaaaatctatgaaatca

SEQ ID NO: 112705 - DNA, 25 bp, mus musculus
atctatgaaatcagcaaccgctgga

SEQ ID NO: 112706 - DNA, 25 bp, mus musculus
tatgaaatcagcaaccgctggaagc

SEQ ID NO: 112707 - DNA, 25 bp, mus musculus
atcagcaaccgctggaagctggcca

SEQ ID NO: 112708 - DNA, 25 bp, mus musculus
agcaaccgctggaagctggccagcc

SEQ ID NO: 112709 - DNA, 25 bp, mus musculus
aagctggccagccaggtccaggtcc

SEQ ID NO: 112710 - DNA, 25 bp, mus musculus
ctggccagccaggtccaggtccaga

SEQ ID NO: 112711 - DNA, 25 bp, mus musculus
gctgagcaaacagctgcccgggagg

SEQ ID NO: 112712 - DNA, 25 bp, mus musculus
ggatgttcctgccgttctctggaac

SEQ ID NO: 112713 - DNA, 25 bp, mus musculus
tgttcctgccgttctctggaacaca

SEQ ID NO: 112714 - DNA, 25 bp, mus musculus
tgccgttctctggaacacaaggccc

SEQ ID NO: 112715 - DNA, 25 bp, mus musculus
cgttctctggaacacaaggcccaca

SEQ ID NO: 112716 - DNA, 25 bp, mus musculus
tctctggaacacaaggcccacatct

SEQ ID NO: 112717 - DNA, 25 bp, mus musculus
gaacacaaggcccacatctctcaag

SEQ ID NO: 112718 - DNA, 25 bp, mus musculus
aaggcccacatctctcaagcagcaa

SEQ ID NO: 112719 - DNA, 25 bp, mus musculus
cacatctctcaagcagcaaagtttg

SEQ ID NO: 112720 - DNA, 25 bp, mus musculus
tctctagctcgcggcctgtgtctat

SEQ ID NO: 112721 - DNA, 25 bp, mus musculus
tctagctcgcggcctgtgtctatgg

SEQ ID NO: 112722 - DNA, 25 bp, mus musculus
agctcttagccgagcgtaagatccc

SEQ ID NO: 112723 - DNA, 25 bp, mus musculus
ctcttagccgagcgtaagatcccct

SEQ ID NO: 112724 - DNA, 25 bp, mus musculus
tcttagccgagcgtaagatcccctg

SEQ ID NO: 112725 - DNA, 25 bp, mus musculus
gccgagcgtaagatcccctgcttcg

SEQ ID NO: 112726 - DNA, 25 bp, mus musculus
gagcgtaagatcccctgcttcgaga

SEQ ID NO: 112727 - DNA, 25 bp, mus musculus
agcgtaagatcccctgcttcgagaa

SEQ ID NO: 112728 - DNA, 25 bp, mus musculus
cgtaagatcccctgcttcgagaatg

SEQ ID NO: 112729 - DNA, 25 bp, mus musculus
gtaagatcccctgcttcgagaatgg

SEQ ID NO: 112730 - DNA, 25 bp, mus musculus
aagatcccctgcttcgagaatggct

SEQ ID NO: 112731 - DNA, 25 bp, mus musculus
agatcccctgcttcgagaatggctg

SEQ ID NO: 112732 - DNA, 25 bp, mus musculus
ctagctcgcggcctgtgtctatggt

SEQ ID NO: 112733 - DNA, 25 bp, mus musculus
agctcgcggcctgtgtctatggtct

SEQ ID NO: 112734 - DNA, 25 bp, mus musculus
cggcctgtgtctatggtctggcccg

SEQ ID NO: 112735 - DNA, 25 bp, mus musculus
ggcctgtgtctatggtctggcccga

SEQ ID NO: 112736 - DNA, 25 bp, mus musculus
aagcgtccagctgcccgggaccgat

SEQ ID NO: 112737 - DNA, 25 bp, mus musculus
tccccggtgtatggcgccgcaggaa

SEQ ID NO: 112738 - DNA, 25 bp, mus musculus
ccagagctcttagccgagcgtaaga

SEQ ID NO: 112739 - DNA, 25 bp, mus musculus
cagagctcttagccgagcgtaagat

SEQ ID NO: 112740 - DNA, 25 bp, mus musculus
cctctggagcccttcagacagctgc

SEQ ID NO: 112741 - DNA, 25 bp, mus musculus
ctggagcccttcagacagctgcgga

SEQ ID NO: 112742 - DNA, 25 bp, mus musculus
tttgctttgcccatcctgaatgccc

SEQ ID NO: 112743 - DNA, 25 bp, mus musculus
tgctttgcccatcctgaatgccctg

SEQ ID NO: 112744 - DNA, 25 bp, mus musculus
gctttgcccatcctgaatgccctgc

SEQ ID NO: 112745 - DNA, 25 bp, mus musculus
tttgcccatcctgaatgccctgctg

SEQ ID NO: 112746 - DNA, 25 bp, mus musculus
ttgcccatcctgaatgccctgctgg

SEQ ID NO: 112747 - DNA, 25 bp, mus musculus
gcccatcctgaatgccctgctggag

SEQ ID NO: 112748 - DNA, 25 bp, mus musculus
atcctgaatgccctgctggagacgc

SEQ ID NO: 112749 - DNA, 25 bp, mus musculus
cctgaatgccctgctggagacgccc

SEQ ID NO: 112750 - DNA, 25 bp, mus musculus
ctgaatgccctgctggagacgcccc

SEQ ID NO: 112751 - DNA, 25 bp, mus musculus
tgccctgctggagacgccccagcga

SEQ ID NO: 112752 - DNA, 25 bp, mus musculus
tggagcccttcagacagctgcggaa

SEQ ID NO: 112753 - DNA, 25 bp, mus musculus
agcccttcagacagctgcggaagag

SEQ ID NO: 112754 - DNA, 25 bp, mus musculus
cccttcagacagctgcggaagagga

SEQ ID NO: 112755 - DNA, 25 bp, mus musculus
ggcaaagcacctaagatccagatcg

SEQ ID NO: 112756 - DNA, 25 bp, mus musculus
caaagcacctaagatccagatcgaa

SEQ ID NO: 112757 - DNA, 25 bp, mus musculus
agcacctaagatccagatcgaagct

SEQ ID NO: 112758 - DNA, 25 bp, mus musculus
gcacctaagatccagatcgaagcta

SEQ ID NO: 112759 - DNA, 25 bp, mus musculus
tgcctttgctttgcccatcctgaat

SEQ ID NO: 112760 - DNA, 25 bp, mus musculus
ccaacacaagctgaccctgtccgaa

SEQ ID NO: 112761 - DNA, 25 bp, mus musculus
acacaagctgaccctgtccgaagta

SEQ ID NO: 112762 - DNA, 25 bp, mus musculus
caggccctgtgtaataccacccaga

SEQ ID NO: 112763 - DNA, 25 bp, mus musculus
ggccctgtgtaataccacccagaat

SEQ ID NO: 112764 - DNA, 25 bp, mus musculus
gccctgtgtaataccacccagaata

SEQ ID NO: 112765 - DNA, 25 bp, mus musculus
gccgggaccatttgggcttgcaaca

SEQ ID NO: 112766 - DNA, 25 bp, mus musculus
tatggccagtttgagagaaaaacca

SEQ ID NO: 112767 - DNA, 25 bp, mus musculus
agagagccggtgtcattaactctgg

SEQ ID NO: 112768 - DNA, 25 bp, mus musculus
gagagccggtgtcattaactctggc

SEQ ID NO: 112769 - DNA, 25 bp, mus musculus
cacaagctgaccctgtccgaagtaa

SEQ ID NO: 112770 - DNA, 25 bp, mus musculus
ggactctgcgtaggagcagttccca

SEQ ID NO: 112771 - DNA, 25 bp, mus musculus
gactctgcgtaggagcagttcccaa

SEQ ID NO: 112772 - DNA, 25 bp, mus musculus
actctgcgtaggagcagttcccaaa

SEQ ID NO: 112773 - DNA, 25 bp, mus musculus
ctctgcgtaggagcagttcccaaaa

SEQ ID NO: 112774 - DNA, 25 bp, mus musculus
tctgcgtaggagcagttcccaaaac

SEQ ID NO: 112775 - DNA, 25 bp, mus musculus
ttcccaaaacccatcaggccctgtg

SEQ ID NO: 112776 - DNA, 25 bp, mus musculus
tcaggccctgtgtaataccacccag

SEQ ID NO: 112777 - DNA, 25 bp, mus musculus
gttggcctcaattggttctttcaga

SEQ ID NO: 112778 - DNA, 25 bp, mus musculus
ctcaattggttctttcagagttaag

SEQ ID NO: 112779 - DNA, 25 bp, mus musculus
atgtcgcacaatgttctgatgtccc

SEQ ID NO: 112780 - DNA, 25 bp, mus musculus
gttctgatgtccctgaaatatcaca

SEQ ID NO: 112781 - DNA, 25 bp, mus musculus
atgtccctgaaatatcacactgagt

SEQ ID NO: 112782 - DNA, 25 bp, mus musculus
ctgaaatatcacactgagttctatc

SEQ ID NO: 112783 - DNA, 25 bp, mus musculus
ttctatcagttattctttgtgagcc

SEQ ID NO: 112784 - DNA, 25 bp, mus musculus
ttctttgtgagcctatgatagtctc

SEQ ID NO: 112785 - DNA, 25 bp, mus musculus
tagtctccatttactgtacaatcat

SEQ ID NO: 112786 - DNA, 25 bp, mus musculus
caatcatgaacagctctgagatcct

SEQ ID NO: 112787 - DNA, 25 bp, mus musculus
gctctgagatcctggagtgatgtgg

SEQ ID NO: 112788 - DNA, 25 bp, mus musculus
agatcctggagtgatgtggtccaga

SEQ ID NO: 112789 - DNA, 25 bp, mus musculus
agcactttgcctgtgccaggtcttc

SEQ ID NO: 112790 - DNA, 25 bp, mus musculus
gcttctctggccaccgtgcatttaa

SEQ ID NO: 112791 - DNA, 25 bp, mus musculus
ggtattcattctttcagtcaccctt

SEQ ID NO: 112792 - DNA, 25 bp, mus musculus
tgtcttgtatcatggctggatccag

SEQ ID NO: 112793 - DNA, 25 bp, mus musculus
gtatcatggctggatccagtgtatt

SEQ ID NO: 112794 - DNA, 25 bp, mus musculus
gtgtattccagctaattgttaatgt

SEQ ID NO: 112795 - DNA, 25 bp, mus musculus
tcgtgactagtcttctgcatgtcgc

SEQ ID NO: 112796 - DNA, 25 bp, mus musculus
ctagtcttctgcatgtcgcacaatg

SEQ ID NO: 112797 - DNA, 25 bp, mus musculus
cccaacagttccagcaactacaggc

SEQ ID NO: 112798 - DNA, 25 bp, mus musculus
aacagttccagcaactacaggccgc

SEQ ID NO: 112799 - DNA, 25 bp, mus musculus
atgacctcaaagctgttgaagaatc

SEQ ID NO: 112800 - DNA, 25 bp, mus musculus
cttcgctgtctgaggtagtcttgca

SEQ ID NO: 112801 - DNA, 25 bp, mus musculus
tagtcttgcagaaccgcagaggctt

SEQ ID NO: 112802 - DNA, 25 bp, mus musculus
tcttgcagaaccgcagaggcttaga

SEQ ID NO: 112803 - DNA, 25 bp, mus musculus
gaggcctttgcgcagccctaaaaga

SEQ ID NO: 112804 - DNA, 25 bp, mus musculus
gcctttgcgcagccctaaaagaaga

SEQ ID NO: 112805 - DNA, 25 bp, mus musculus
tttgcgcagccctaaaagaagagtg

SEQ ID NO: 112806 - DNA, 25 bp, mus musculus
agtgctgcttctatgccgaccatac

SEQ ID NO: 112807 - DNA, 25 bp, mus musculus
atgccgaccatacaggattagttag

SEQ ID NO: 112808 - DNA, 25 bp, mus musculus
ttatgggccctctgatagtactttt

SEQ ID NO: 112809 - DNA, 25 bp, mus musculus
agcaactacaggccgccatgcataa

SEQ ID NO: 112810 - DNA, 25 bp, mus musculus
aactacaggccgccatgcataatga

SEQ ID NO: 112811 - DNA, 25 bp, mus musculus
tacaggccgccatgcataatgacct

SEQ ID NO: 112812 - DNA, 25 bp, mus musculus
aggccgccatgcataatgacctcaa

SEQ ID NO: 112813 - DNA, 25 bp, mus musculus
ccgccatgcataatgacctcaaagc

SEQ ID NO: 112814 - DNA, 25 bp, mus musculus
ccatgcataatgacctcaaagctgt

SEQ ID NO: 112815 - DNA, 25 bp, mus musculus
tgcataatgacctcaaagctgttga

SEQ ID NO: 112816 - DNA, 25 bp, mus musculus
ataatgacctcaaagctgttgaaga

SEQ ID NO: 112817 - DNA, 25 bp, mus musculus
gcctcagcactcatttctgtgtggc

SEQ ID NO: 112818 - DNA, 25 bp, mus musculus
aggcgctatgctttcccagatctct

SEQ ID NO: 112819 - DNA, 25 bp, mus musculus
cagtctagaaggcccaactgccacc

SEQ ID NO: 112820 - DNA, 25 bp, mus musculus
ctagaaggcccaactgccaccactg

SEQ ID NO: 112821 - DNA, 25 bp, mus musculus
agaaggcccaactgccaccactggt

SEQ ID NO: 112822 - DNA, 25 bp, mus musculus
caactgccaccactggttcctggga

SEQ ID NO: 112823 - DNA, 25 bp, mus musculus
aatgccctgaaactataggatggtg

SEQ ID NO: 112824 - DNA, 25 bp, mus musculus
tgccctgaaactataggatggtgac

SEQ ID NO: 112825 - DNA, 25 bp, mus musculus
tacaaggccttgggtaagatattgc

SEQ ID NO: 112826 - DNA, 25 bp, mus musculus
ggctctcctatttcagttcatgtgc

SEQ ID NO: 112827 - DNA, 25 bp, mus musculus
ctcctatttcagttcatgtgccaag

SEQ ID NO: 112828 - DNA, 25 bp, mus musculus
cctatttcagttcatgtgccaagca

SEQ ID NO: 112829 - DNA, 25 bp, mus musculus
gcgctatgctttcccagatctcttg

SEQ ID NO: 112830 - DNA, 25 bp, mus musculus
agttcatgtgccaagcatccaacta

SEQ ID NO: 112831 - DNA, 25 bp, mus musculus
tatgctttcccagatctcttgggca

SEQ ID NO: 112832 - DNA, 25 bp, mus musculus
tgctttcccagatctcttgggcacc

SEQ ID NO: 112833 - DNA, 25 bp, mus musculus
ctttcccagatctcttgggcaccca

SEQ ID NO: 112834 - DNA, 25 bp, mus musculus
ttcccagatctcttgggcacccagg

SEQ ID NO: 112835 - DNA, 25 bp, mus musculus
cagatctcttgggcacccagggaag

SEQ ID NO: 112836 - DNA, 25 bp, mus musculus
ccccaaggccttgtcagtctagaag

SEQ ID NO: 112837 - DNA, 25 bp, mus musculus
ccaaggccttgtcagtctagaaggc

SEQ ID NO: 112838 - DNA, 25 bp, mus musculus
tatactgcttgtgcacggctgccca

SEQ ID NO: 112839 - DNA, 25 bp, mus musculus
actgcttgtgcacggctgcccaatg

SEQ ID NO: 112840 - DNA, 25 bp, mus musculus
gtcgtgacgcgctatgcctatgttc

SEQ ID NO: 112841 - DNA, 25 bp, mus musculus
gtgacgcgctatgcctatgttctct

SEQ ID NO: 112842 - DNA, 25 bp, mus musculus
tatgcctatgttctcttctaccgtc

SEQ ID NO: 112843 - DNA, 25 bp, mus musculus
gcctatgttctcttctaccgtcgtc

SEQ ID NO: 112844 - DNA, 25 bp, mus musculus
tatgttctcttctaccgtcgtcgga

SEQ ID NO: 112845 - DNA, 25 bp, mus musculus
ttctaccgtcgtcggaactctcctg

SEQ ID NO: 112846 - DNA, 25 bp, mus musculus
taccgtcgtcggaactctcctgtgg

SEQ ID NO: 112847 - DNA, 25 bp, mus musculus
cgtcggaactctcctgtggagagac

SEQ ID NO: 112848 - DNA, 25 bp, mus musculus
ccagacctaggccctgcagctgagg

SEQ ID NO: 112849 - DNA, 25 bp, mus musculus
cctgcagctgaggctgtgccagcca

SEQ ID NO: 112850 - DNA, 25 bp, mus musculus
gcacggctgcccaatgatcgcagta

SEQ ID NO: 112851 - DNA, 25 bp, mus musculus
cggctgcccaatgatcgcagtagcc

SEQ ID NO: 112852 - DNA, 25 bp, mus musculus
ctgcccaatgatcgcagtagccagc

SEQ ID NO: 112853 - DNA, 25 bp, mus musculus
cccaatgatcgcagtagccagcgca

SEQ ID NO: 112854 - DNA, 25 bp, mus musculus
gatcgcagtagccagcgcagtgacg

SEQ ID NO: 112855 - DNA, 25 bp, mus musculus
cgcagtagccagcgcagtgacgtgg

SEQ ID NO: 112856 - DNA, 25 bp, mus musculus
gaaagccaggtcgtgacgcgctatg

SEQ ID NO: 112857 - DNA, 25 bp, mus musculus
caggtcgtgacgcgctatgcctatg

SEQ ID NO: 112858 - DNA, 25 bp, mus musculus
atccactgccttggagactttggac

SEQ ID NO: 112859 - DNA, 25 bp, mus musculus
ccactgccttggagactttggacac

SEQ ID NO: 112860 - DNA, 25 bp, mus musculus
aactcagtggtcccacagaacctca

SEQ ID NO: 112861 - DNA, 25 bp, mus musculus
cagtggtcccacagaacctcagcgt

SEQ ID NO: 112862 - DNA, 25 bp, mus musculus
gtggtcccacagaacctcagcgtgc

SEQ ID NO: 112863 - DNA, 25 bp, mus musculus
acagaacctcagcgtgcccgtcttc

SEQ ID NO: 112864 - DNA, 25 bp, mus musculus
cgtgcccgtcttctgcccatcaagg

SEQ ID NO: 112865 - DNA, 25 bp, mus musculus
tgcccgtcttctgcccatcaaggag

SEQ ID NO: 112866 - DNA, 25 bp, mus musculus
cccgtcttctgcccatcaaggagca

SEQ ID NO: 112867 - DNA, 25 bp, mus musculus
tcttctgcccatcaaggagcactct

SEQ ID NO: 112868 - DNA, 25 bp, mus musculus
ttctgcccatcaaggagcactctgt

SEQ ID NO: 112869 - DNA, 25 bp, mus musculus
atcaaggagcactctgtctcctagg

SEQ ID NO: 112870 - DNA, 25 bp, mus musculus
tgccttggagactttggacacagag

SEQ ID NO: 112871 - DNA, 25 bp, mus musculus
caaggagcactctgtctcctaggcg

SEQ ID NO: 112872 - DNA, 25 bp, mus musculus
aacgctgccatcgttcttgccttct

SEQ ID NO: 112873 - DNA, 25 bp, mus musculus
gttcttgccttctggttcatctagc

SEQ ID NO: 112874 - DNA, 25 bp, mus musculus
tcttgccttctggttcatctagctc

SEQ ID NO: 112875 - DNA, 25 bp, mus musculus
acgcccaaccactgggcgctggcga

SEQ ID NO: 112876 - DNA, 25 bp, mus musculus
gcccaaccactgggcgctggcgaac

SEQ ID NO: 112877 - DNA, 25 bp, mus musculus
ccaaccactgggcgctggcgaactc

SEQ ID NO: 112878 - DNA, 25 bp, mus musculus
ccactgggcgctggcgaactcagtg

SEQ ID NO: 112879 - DNA, 25 bp, mus musculus
agctagacttaatgctttagaagaa

SEQ ID NO: 112880 - DNA, 25 bp, mus musculus
tagacttaatgctttagaagaagta

SEQ ID NO: 112881 - DNA, 25 bp, mus musculus
gaagagccttgaccaagtgcagtca

SEQ ID NO: 112882 - DNA, 25 bp, mus musculus
gagccttgaccaagtgcagtcagat

SEQ ID NO: 112883 - DNA, 25 bp, mus musculus
ccaagtgcagtcagatcttaacgtg

SEQ ID NO: 112884 - DNA, 25 bp, mus musculus
agtgcagtcagatcttaacgtgctt

SEQ ID NO: 112885 - DNA, 25 bp, mus musculus
gcagtcagatcttaacgtgcttctt

SEQ ID NO: 112886 - DNA, 25 bp, mus musculus
ccaaggacgacctgtctgcgcacaa

SEQ ID NO: 112887 - DNA, 25 bp, mus musculus
aggacgacctgtctgcgcacaaacg

SEQ ID NO: 112888 - DNA, 25 bp, mus musculus
acctgtctgcgcacaaacggatgag

SEQ ID NO: 112889 - DNA, 25 bp, mus musculus
tgtctgcgcacaaacggatgagccc

SEQ ID NO: 112890 - DNA, 25 bp, mus musculus
ctgcgcacaaacggatgagcccatc

SEQ ID NO: 112891 - DNA, 25 bp, mus musculus
agttttagagttgggtcaagatgtg

SEQ ID NO: 112892 - DNA, 25 bp, mus musculus
tttagagttgggtcaagatgtggca

SEQ ID NO: 112893 - DNA, 25 bp, mus musculus
aaccagagcacatttattgggcatt

SEQ ID NO: 112894 - DNA, 25 bp, mus musculus
tggagccctgcttttggtcatagta

SEQ ID NO: 112895 - DNA, 25 bp, mus musculus
agccctgcttttggtcatagtactt

SEQ ID NO: 112896 - DNA, 25 bp, mus musculus
tatgattttccccattgttttccag

SEQ ID NO: 112897 - DNA, 25 bp, mus musculus
cattgttttccagtgccttgcgaag

SEQ ID NO: 112898 - DNA, 25 bp, mus musculus
tgttttccagtgccttgcgaagagc

SEQ ID NO: 112899 - DNA, 25 bp, mus musculus
caaggcctgtccctgctctcagaag

SEQ ID NO: 112900 - DNA, 25 bp, mus musculus
ctgctctcagaagccatcctgcagg

SEQ ID NO: 112901 - DNA, 25 bp, mus musculus
tgctccccgtcactgtgtcatgcca

SEQ ID NO: 112902 - DNA, 25 bp, mus musculus
ccagtctgtcccatggacactccag

SEQ ID NO: 112903 - DNA, 25 bp, mus musculus
tgtcccatggacactccagcaccag

SEQ ID NO: 112904 - DNA, 25 bp, mus musculus
atggacactccagcaccagcagtga

SEQ ID NO: 112905 - DNA, 25 bp, mus musculus
actccagcaccagcagtgacatcct

SEQ ID NO: 112906 - DNA, 25 bp, mus musculus
gaacttcccagagctccattctgaa

SEQ ID NO: 112907 - DNA, 25 bp, mus musculus
cccagagctccattctgaaatctaa

SEQ ID NO: 112908 - DNA, 25 bp, mus musculus
gctccattctgaaatctaaagatgt

SEQ ID NO: 112909 - DNA, 25 bp, mus musculus
gacaagcccgaggcccagagaagaa

SEQ ID NO: 112910 - DNA, 25 bp, mus musculus
cccgaggcccagagaagaagagcct

SEQ ID NO: 112911 - DNA, 25 bp, mus musculus
ccaccagagacccttcagcttcata

SEQ ID NO: 112912 - DNA, 25 bp, mus musculus
atagacaaagccatcagtggtctac

SEQ ID NO: 112913 - DNA, 25 bp, mus musculus
aaagccatcagtggtctacgtagcc

SEQ ID NO: 112914 - DNA, 25 bp, mus musculus
atcagtggtctacgtagcctcactt

SEQ ID NO: 112915 - DNA, 25 bp, mus musculus
cgtagcctcacttcactgcttcggg

SEQ ID NO: 112916 - DNA, 25 bp, mus musculus
ctcacttcactgcttcgggtactgg

SEQ ID NO: 112917 - DNA, 25 bp, mus musculus
gaattgatgtcgcctccagatacca

SEQ ID NO: 112918 - DNA, 25 bp, mus musculus
ctcacagtggatactttctgcaagc

SEQ ID NO: 112919 - DNA, 25 bp, mus musculus
tggtttctcatttttgaatcaacat

SEQ ID NO: 112920 - DNA, 25 bp, mus musculus
tttgaatcaacatcttttccttctg

SEQ ID NO: 112921 - DNA, 25 bp, mus musculus
ccctattgtgtctccttctctggga

SEQ ID NO: 112922 - DNA, 25 bp, mus musculus
agctaaaagcagcctttctcaggtg

SEQ ID NO: 112923 - DNA, 25 bp, mus musculus
atttatatgtatcccatagtctcta

SEQ ID NO: 112924 - DNA, 25 bp, mus musculus
atgtatcccatagtctctaaatggg

SEQ ID NO: 112925 - DNA, 25 bp, mus musculus
agtagccatcaggtcttgatcctaa

SEQ ID NO: 112926 - DNA, 25 bp, mus musculus
agccatcaggtcttgatcctaaact

SEQ ID NO: 112927 - DNA, 25 bp, mus musculus
ttgatcctaaactcatagacgtgta

SEQ ID NO: 112928 - DNA, 25 bp, mus musculus
tgattctagcacagacctcattgac

SEQ ID NO: 112929 - DNA, 25 bp, mus musculus
agacctcattgacagactgactaga

SEQ ID NO: 112930 - DNA, 25 bp, mus musculus
cctcattgacagactgactagaatt

SEQ ID NO: 112931 - DNA, 25 bp, mus musculus
gaatcaacatcttttccttctgtcc

SEQ ID NO: 112932 - DNA, 25 bp, mus musculus
ttggtcactaccctccaactctagg

SEQ ID NO: 112933 - DNA, 25 bp, mus musculus
ggagaagccctaggcttgagatttc

SEQ ID NO: 112934 - DNA, 25 bp, mus musculus
tttcatctgctctccttcctgcatc

SEQ ID NO: 112935 - DNA, 25 bp, mus musculus
gcccccaggactgggccacttgtgg

SEQ ID NO: 112936 - DNA, 25 bp, mus musculus
ccacttgtggggcagccagttctag

SEQ ID NO: 112937 - DNA, 25 bp, mus musculus
cagccagttctagcacagctcacac

SEQ ID NO: 112938 - DNA, 25 bp, mus musculus
gcacagctcacactgagagtgtaag

SEQ ID NO: 112939 - DNA, 25 bp, mus musculus
aatatgactccatctccagactgga

SEQ ID NO: 112940 - DNA, 25 bp, mus musculus
ccatctccagactggaccagtggct

SEQ ID NO: 112941 - DNA, 25 bp, mus musculus
ttccacccatctgtctatcacagag

SEQ ID NO: 112942 - DNA, 25 bp, mus musculus
ccatctgtctatcacagaggtggag

SEQ ID NO: 112943 - DNA, 25 bp, mus musculus
tctgtctatcacagaggtggagcca

SEQ ID NO: 112944 - DNA, 25 bp, mus musculus
tatcacagaggtggagccagcacct

SEQ ID NO: 112945 - DNA, 25 bp, mus musculus
tcccaccaggagtctgaaggagtgg

SEQ ID NO: 112946 - DNA, 25 bp, mus musculus
atgtgggccacattctccagcacca

SEQ ID NO: 112947 - DNA, 25 bp, mus musculus
tgggccacattctccagcaccaggc

SEQ ID NO: 112948 - DNA, 25 bp, mus musculus
tccagcaccaggcgagctctcctgg

SEQ ID NO: 112949 - DNA, 25 bp, mus musculus
accaggcgagctctcctggatggct

SEQ ID NO: 112950 - DNA, 25 bp, mus musculus
aggcgagctctcctggatggctggt

SEQ ID NO: 112951 - DNA, 25 bp, mus musculus
tctccagactggaccagtggcttac

SEQ ID NO: 112952 - DNA, 25 bp, mus musculus
ccagactggaccagtggcttaccac

SEQ ID NO: 112953 - DNA, 25 bp, mus musculus
accagtggcttaccaccatgcttct

SEQ ID NO: 112954 - DNA, 25 bp, mus musculus
agtggcttaccaccatgcttctgcg

SEQ ID NO: 112955 - DNA, 25 bp, mus musculus
ggcttaccaccatgcttctgcgcat

SEQ ID NO: 112956 - DNA, 25 bp, mus musculus
ccaccatgcttctgcgcataaagaa

SEQ ID NO: 112957 - DNA, 25 bp, mus musculus
ccatgcttctgcgcataaagaagac

SEQ ID NO: 112958 - DNA, 25 bp, mus musculus
aggacctgcgctaggcctccagcca

SEQ ID NO: 112959 - DNA, 25 bp, mus musculus
caggctttgacggcgacagaagggc

SEQ ID NO: 112960 - DNA, 25 bp, mus musculus
tacagccaatcagccatctgcaggt

SEQ ID NO: 112961 - DNA, 25 bp, mus musculus
tccttcacaccgcaggccatagagg

SEQ ID NO: 112962 - DNA, 25 bp, mus musculus
acaccgcaggccatagaggctctca

SEQ ID NO: 112963 - DNA, 25 bp, mus musculus
atagaggctctcaatgcctactttg

SEQ ID NO: 112964 - DNA, 25 bp, mus musculus
ttctgtaatcgacgccagacactga

SEQ ID NO: 112965 - DNA, 25 bp, mus musculus
aatcgacgccagacactgaagaaca

SEQ ID NO: 112966 - DNA, 25 bp, mus musculus
acactgaagaacaccagcaagctga

SEQ ID NO: 112967 - DNA, 25 bp, mus musculus
accagcaagctgaacgtctttcaga

SEQ ID NO: 112968 - DNA, 25 bp, mus musculus
tttcagatcccgtaggctcagtgtc

SEQ ID NO: 112969 - DNA, 25 bp, mus musculus
atcccgtaggctcagtgtcagcgtg

SEQ ID NO: 112970 - DNA, 25 bp, mus musculus
taggctcagtgtcagcgtgtgccgg

SEQ ID NO: 112971 - DNA, 25 bp, mus musculus
gccatctgcaggtttgagaaattgg

SEQ ID NO: 112972 - DNA, 25 bp, mus musculus
aaattggacatcacacccaagagcg

SEQ ID NO: 112973 - DNA, 25 bp, mus musculus
gacatcacacccaagagcgcccaga

SEQ ID NO: 112974 - DNA, 25 bp, mus musculus
acacccaagagcgcccagaagctga

SEQ ID NO: 112975 - DNA, 25 bp, mus musculus
aagagcgcccagaagctgaagccgg

SEQ ID NO: 112976 - DNA, 25 bp, mus musculus
gcagagctccgcaaccaggaaggcc

SEQ ID NO: 112977 - DNA, 25 bp, mus musculus
gagccctccaagaaacgcaagcggc

SEQ ID NO: 112978 - DNA, 25 bp, mus musculus
aaacgcaagcggcgcacttccttca

SEQ ID NO: 112979 - DNA, 25 bp, mus musculus
gagaacctctcagggcctgggggca

SEQ ID NO: 112980 - DNA, 25 bp, mus musculus
agtgtggaccctgtgactatggatg

SEQ ID NO: 112981 - DNA, 25 bp, mus musculus
cacttgaagtacctataccttgtgg

SEQ ID NO: 112982 - DNA, 25 bp, mus musculus
cttgtggtgtccgattctggcatct

SEQ ID NO: 112983 - DNA, 25 bp, mus musculus
ggcatctcaacagattacagttcgg

SEQ ID NO: 112984 - DNA, 25 bp, mus musculus
tatgagaacagccttgtcccagact

SEQ ID NO: 112985 - DNA, 25 bp, mus musculus
cttgtcccagactcagagcctctgc

SEQ ID NO: 112986 - DNA, 25 bp, mus musculus
ggctatgtggcctgctcctaggact

SEQ ID NO: 112987 - DNA, 25 bp, mus musculus
taggactccagcctacaacgtcttg

SEQ ID NO: 112988 - DNA, 25 bp, mus musculus
tccagcctacaacgtcttgaacggg

SEQ ID NO: 112989 - DNA, 25 bp, mus musculus
cagagctgaccttggccctctgagc

SEQ ID NO: 112990 - DNA, 25 bp, mus musculus
gagacagccttgcaatgttaagatt

SEQ ID NO: 112991 - DNA, 25 bp, mus musculus
gaagcttcagaaacatcttcctgcc

SEQ ID NO: 112992 - DNA, 25 bp, mus musculus
tcagaaacatcttcctgcccgtctg

SEQ ID NO: 112993 - DNA, 25 bp, mus musculus
ccgtctgacttggcctcaaagccca

SEQ ID NO: 112994 - DNA, 25 bp, mus musculus
gacttggcctcaaagcccaggccag

SEQ ID NO: 112995 - DNA, 25 bp, mus musculus
gcctcaaagcccaggccagagggca

SEQ ID NO: 112996 - DNA, 25 bp, mus musculus
acctcaccttccagctttgagtaca

SEQ ID NO: 112997 - DNA, 25 bp, mus musculus
ccttccagctttgagtacaccatcc

SEQ ID NO: 112998 - DNA, 25 bp, mus musculus
agctttgagtacaccatcctggacc

SEQ ID NO: 112999 - DNA, 25 bp, mus musculus
gcacaggaagctggctgcagtgcct

SEQ ID NO: 113000 - DNA, 25 bp, mus musculus
ggctgcagtgccttcctcatgaagg

SEQ ID NO: 113001 - DNA, 25 bp, mus musculus
tagtttagtgcggccagtgactgct

SEQ ID NO: 113002 - DNA, 25 bp, mus musculus
tttagtgcggccagtgactgcttca

SEQ ID NO: 113003 - DNA, 25 bp, mus musculus
gccagtgactgcttcaagagacttc

SEQ ID NO: 113004 - DNA, 25 bp, mus musculus
aagagacttctgaccttgcttccca

SEQ ID NO: 113005 - DNA, 25 bp, mus musculus
gctaactgtctttatggaaggcact

SEQ ID NO: 113006 - DNA, 25 bp, mus musculus
tatttgcccattgtacagagcaatg

SEQ ID NO: 113007 - DNA, 25 bp, mus musculus
agcactgtgtgactttgtgaaggac

SEQ ID NO: 113008 - DNA, 25 bp, mus musculus
cactgccttggaaatgttgactgac

SEQ ID NO: 113009 - DNA, 25 bp, mus musculus
tgacgtttatgcctggtgatagcat

SEQ ID NO: 113010 - DNA, 25 bp, mus musculus
ttatgcctggtgatagcattcccga

SEQ ID NO: 113011 - DNA, 25 bp, mus musculus
gccttcctcatgaaggatctaccac

SEQ ID NO: 113012 - DNA, 25 bp, mus musculus
aactgcacagttgaacgcagatttt

SEQ ID NO: 113013 - DNA, 25 bp, mus musculus
tttttatccataggtaactgtagtg

SEQ ID NO: 113014 - DNA, 25 bp, mus musculus
tttttaggggcttgagagctgccac

SEQ ID NO: 113015 - DNA, 25 bp, mus musculus
gcttgagagctgccacctggcattt

SEQ ID NO: 113016 - DNA, 25 bp, mus musculus
ctgccacctggcatttagtttagtg

SEQ ID NO: 113017 - DNA, 25 bp, mus musculus
ccacctggcatttagtttagtgcgg

SEQ ID NO: 113018 - DNA, 25 bp, mus musculus
atttagtttagtgcggccagtgact

SEQ ID NO: 113019 - DNA, 25 bp, mus musculus
tgtcttgagcatcttcgtgaacatc

SEQ ID NO: 113020 - DNA, 25 bp, mus musculus
gagcatcttcgtgaacatctatctc

SEQ ID NO: 113021 - DNA, 25 bp, mus musculus
ctctccactcatgcctcaggatcag

SEQ ID NO: 113022 - DNA, 25 bp, mus musculus
actcatgcctcaggatcagctcaca

SEQ ID NO: 113023 - DNA, 25 bp, mus musculus
aatgtcaccaaagctggtttgctgc

SEQ ID NO: 113024 - DNA, 25 bp, mus musculus
ccagctcgtgagatcctggtcattt

SEQ ID NO: 113025 - DNA, 25 bp, mus musculus
atcctggtcatttctggacagtccc

SEQ ID NO: 113026 - DNA, 25 bp, mus musculus
tctggacagtcccttggtttactca

SEQ ID NO: 113027 - DNA, 25 bp, mus musculus
atctccctctgaacaaagaaagcag

SEQ ID NO: 113028 - DNA, 25 bp, mus musculus
ggcatcgcccatgtgcacactccag

SEQ ID NO: 113029 - DNA, 25 bp, mus musculus
gcccatgtgcacactccagatggct

SEQ ID NO: 113030 - DNA, 25 bp, mus musculus
gtgcacactccagatggctagtgag

SEQ ID NO: 113031 - DNA, 25 bp, mus musculus
cttcgtgaacatctatctcatgatg

SEQ ID NO: 113032 - DNA, 25 bp, mus musculus
gaacatctatctcatgatgcagctg

SEQ ID NO: 113033 - DNA, 25 bp, mus musculus
ctatctcatgatgcagctggaccag

SEQ ID NO: 113034 - DNA, 25 bp, mus musculus
caccatctatttcggttatgggatc

SEQ ID NO: 113035 - DNA, 25 bp, mus musculus
tggccaggcaaagactcctgacagc

SEQ ID NO: 113036 - DNA, 25 bp, mus musculus
ggcaaagactcctgacagcaacttg

SEQ ID NO: 113037 - DNA, 25 bp, mus musculus
gactcctgacagcaacttggaccag

SEQ ID NO: 113038 - DNA, 25 bp, mus musculus
tgacagcaacttggaccagtgcaaa

SEQ ID NO: 113039 - DNA, 25 bp, mus musculus
agttcacagcacagatgggcagaga

SEQ ID NO: 113040 - DNA, 25 bp, mus musculus
tcacagcacagatgggcagagatgg

SEQ ID NO: 113041 - DNA, 25 bp, mus musculus
atctgtggtagccagtgttcctatg

SEQ ID NO: 113042 - DNA, 25 bp, mus musculus
ggtagccagtgttcctatgttctgc

SEQ ID NO: 113043 - DNA, 25 bp, mus musculus
cagtgttcctatgttctgctagtac

SEQ ID NO: 113044 - DNA, 25 bp, mus musculus
tcctatgttctgctagtacctgggt

SEQ ID NO: 113045 - DNA, 25 bp, mus musculus
tatgttctgctagtacctgggtcac

SEQ ID NO: 113046 - DNA, 25 bp, mus musculus
ctagtacctgggtcaccagccatag

SEQ ID NO: 113047 - DNA, 25 bp, mus musculus
gtacctgggtcaccagccatagggt

SEQ ID NO: 113048 - DNA, 25 bp, mus musculus
cctgggtcaccagccatagggtaca

SEQ ID NO: 113049 - DNA, 25 bp, mus musculus
tcaccagccatagggtacagccagc

SEQ ID NO: 113050 - DNA, 25 bp, mus musculus
cagccccagtgtgtggtcttgttgg

SEQ ID NO: 113051 - DNA, 25 bp, mus musculus
gagatggtccccacagcttcagccc

SEQ ID NO: 113052 - DNA, 25 bp, mus musculus
catcatccccagaggccgagcaggg

SEQ ID NO: 113053 - DNA, 25 bp, mus musculus
catccccagaggccgagcagggagg

SEQ ID NO: 113054 - DNA, 25 bp, mus musculus
gagctgagcccctgaaatcctgcac

SEQ ID NO: 113055 - DNA, 25 bp, mus musculus
agcccctgaaatcctgcacgtagct

SEQ ID NO: 113056 - DNA, 25 bp, mus musculus
ccctgaaatcctgcacgtagctgag

SEQ ID NO: 113057 - DNA, 25 bp, mus musculus
tgaaatcctgcacgtagctgagtga

SEQ ID NO: 113058 - DNA, 25 bp, mus musculus
aatcctgcacgtagctgagtgagct

SEQ ID NO: 113059 - DNA, 25 bp, mus musculus
tgggatggcctcaggatggtacttt

SEQ ID NO: 113060 - DNA, 25 bp, mus musculus
ttaagtattatctctcaggttaagt

SEQ ID NO: 113061 - DNA, 25 bp, mus musculus
caggttctccctgatagcggcggac

SEQ ID NO: 113062 - DNA, 25 bp, mus musculus
ctgatagcggcggacccctcattga

SEQ ID NO: 113063 - DNA, 25 bp, mus musculus
attgaccttctcacagaggacctcc

SEQ ID NO: 113064 - DNA, 25 bp, mus musculus
tacggagcacaaccttcctcctctg

SEQ ID NO: 113065 - DNA, 25 bp, mus musculus
tcctcctctgccagagagaacgata

SEQ ID NO: 113066 - DNA, 25 bp, mus musculus
cctcctctgccagagagaacgataa

SEQ ID NO: 113067 - DNA, 25 bp, mus musculus
tcctctgccagagagaacgataaag

SEQ ID NO: 113068 - DNA, 25 bp, mus musculus
gcagcggactccatcatctcccagg

SEQ ID NO: 113069 - DNA, 25 bp, mus musculus
gcggactccatcatctcccaggcat

SEQ ID NO: 113070 - DNA, 25 bp, mus musculus
cggactccatcatctcccaggcatt

SEQ ID NO: 113071 - DNA, 25 bp, mus musculus
taagtattatctctcaggttaagtc

SEQ ID NO: 113072 - DNA, 25 bp, mus musculus
agtattatctctcaggttaagtcta

SEQ ID NO: 113073 - DNA, 25 bp, mus musculus
gtattatctctcaggttaagtctag

SEQ ID NO: 113074 - DNA, 25 bp, mus musculus
attatctctcaggttaagtctagag

SEQ ID NO: 113075 - DNA, 25 bp, mus musculus
ttatctctcaggttaagtctagagt

SEQ ID NO: 113076 - DNA, 25 bp, mus musculus
atctctcaggttaagtctagagtgt

SEQ ID NO: 113077 - DNA, 25 bp, mus musculus
tctctcaggttaagtctagagtgtt

SEQ ID NO: 113078 - DNA, 25 bp, mus musculus
ctaagccccaggttctccctgatag

SEQ ID NO: 113079 - DNA, 25 bp, mus musculus
tcctatccttgctgcatctgatgaa

SEQ ID NO: 113080 - DNA, 25 bp, mus musculus
ccttgctgcatctgatgaagaagac

SEQ ID NO: 113081 - DNA, 25 bp, mus musculus
atgagaagcccaccatatggcttcc

SEQ ID NO: 113082 - DNA, 25 bp, mus musculus
agaagcccaccatatggcttcctgg

SEQ ID NO: 113083 - DNA, 25 bp, mus musculus
ccatatggcttcctggaaagcgact

SEQ ID NO: 113084 - DNA, 25 bp, mus musculus
tatggcttcctggaaagcgactctt

SEQ ID NO: 113085 - DNA, 25 bp, mus musculus
gaaagcgactcttgacagctatgct

SEQ ID NO: 113086 - DNA, 25 bp, mus musculus
agcgactcttgacagctatgctagc

SEQ ID NO: 113087 - DNA, 25 bp, mus musculus
gactcttgacagctatgctagctgt

SEQ ID NO: 113088 - DNA, 25 bp, mus musculus
tagctgtatacagctgagtgctatt

SEQ ID NO: 113089 - DNA, 25 bp, mus musculus
tatacagctgagtgctattgccctt

SEQ ID NO: 113090 - DNA, 25 bp, mus musculus
cagctgagtgctattgcccttctta

SEQ ID NO: 113091 - DNA, 25 bp, mus musculus
tgaagaagacaccctattagactat

SEQ ID NO: 113092 - DNA, 25 bp, mus musculus
ctgagtgctattgcccttcttacgg

SEQ ID NO: 113093 - DNA, 25 bp, mus musculus
tgtgacaccatgtctgggactggag

SEQ ID NO: 113094 - DNA, 25 bp, mus musculus
gacaccatgtctgggactggagaag

SEQ ID NO: 113095 - DNA, 25 bp, mus musculus
gctctgtgaacttcagatcgcatgg

SEQ ID NO: 113096 - DNA, 25 bp, mus musculus
tgaacttcagatcgcatggctatga

SEQ ID NO: 113097 - DNA, 25 bp, mus musculus
acttcagatcgcatggctatgagaa

SEQ ID NO: 113098 - DNA, 25 bp, mus musculus
tcagatcgcatggctatgagaagcc

SEQ ID NO: 113099 - DNA, 25 bp, mus musculus
gctatgagaagcccaccatatggct

SEQ ID NO: 113100 - DNA, 25 bp, mus musculus
gatatctatccctgagcttctcaca

SEQ ID NO: 113101 - DNA, 25 bp, mus musculus
tatccctgagcttctcacacatccg

SEQ ID NO: 113102 - DNA, 25 bp, mus musculus
ttcttcgtcatccaagacttttgac

SEQ ID NO: 113103 - DNA, 25 bp, mus musculus
gtgatgcacagctacgtacaaacca

SEQ ID NO: 113104 - DNA, 25 bp, mus musculus
tacgtacaaaccaagaacactagat

SEQ ID NO: 113105 - DNA, 25 bp, mus musculus
actagattgtttcctctgccatact

SEQ ID NO: 113106 - DNA, 25 bp, mus musculus
cctctgccatactcttgaatctctg

SEQ ID NO: 113107 - DNA, 25 bp, mus musculus
ccatactcttgaatctctgaggaaa

SEQ ID NO: 113108 - DNA, 25 bp, mus musculus
gtaaagttaaccactcatagcactg

SEQ ID NO: 113109 - DNA, 25 bp, mus musculus
ttaaccactcatagcactgtgtata

SEQ ID NO: 113110 - DNA, 25 bp, mus musculus
tgcttttctgtaaatctgctaatgt

SEQ ID NO: 113111 - DNA, 25 bp, mus musculus
taaataaagcgtcaccacagttcca

SEQ ID NO: 113112 - DNA, 25 bp, mus musculus
tgagcttctcacacatccgtatgtt

SEQ ID NO: 113113 - DNA, 25 bp, mus musculus
tctcacacatccgtatgttcaaatt

SEQ ID NO: 113114 - DNA, 25 bp, mus musculus
aggcagccaaatggctaggggagcc

SEQ ID NO: 113115 - DNA, 25 bp, mus musculus
gggtcaacttgttggtctgaattct

SEQ ID NO: 113116 - DNA, 25 bp, mus musculus
gaattctcctaactccatcttgaaa

SEQ ID NO: 113117 - DNA, 25 bp, mus musculus
tcctaactccatcttgaaaactgca

SEQ ID NO: 113118 - DNA, 25 bp, mus musculus
ctccatcttgaaaactgcaaaaact

SEQ ID NO: 113119 - DNA, 25 bp, mus musculus
tcaagattcttcgtcatccaagact

SEQ ID NO: 113120 - DNA, 25 bp, mus musculus
gtacaggatcgcctggaactggaaa

SEQ ID NO: 113121 - DNA, 25 bp, mus musculus
caggatcgcctggaactggaaattc

SEQ ID NO: 113122 - DNA, 25 bp, mus musculus
ttcgagacagctctgcagcttaaag

SEQ ID NO: 113123 - DNA, 25 bp, mus musculus
aatcccatggtcatgtgactccaga

SEQ ID NO: 113124 - DNA, 25 bp, mus musculus
atggtcatgtgactccagatacttc

SEQ ID NO: 113125 - DNA, 25 bp, mus musculus
atgtgactccagatacttctgggaa

SEQ ID NO: 113126 - DNA, 25 bp, mus musculus
tgactccagatacttctgggaatgg

SEQ ID NO: 113127 - DNA, 25 bp, mus musculus
ctccagatacttctgggaatggttg

SEQ ID NO: 113128 - DNA, 25 bp, mus musculus
cagatacttctgggaatggttgaat

SEQ ID NO: 113129 - DNA, 25 bp, mus musculus
atacttctgggaatggttgaataca

SEQ ID NO: 113130 - DNA, 25 bp, mus musculus
agattatgaacgcctcagggatgtt

SEQ ID NO: 113131 - DNA, 25 bp, mus musculus
ttatgaacgcctcagggatgttggc

SEQ ID NO: 113132 - DNA, 25 bp, mus musculus
attctgagctgccatgtgggtgctg

SEQ ID NO: 113133 - DNA, 25 bp, mus musculus
agctgccatgtgggtgctgggaatc

SEQ ID NO: 113134 - DNA, 25 bp, mus musculus
tgccatgtgggtgctgggaatctag

SEQ ID NO: 113135 - DNA, 25 bp, mus musculus
gggaatctaggccctcagatcaatg

SEQ ID NO: 113136 - DNA, 25 bp, mus musculus
aatctaggccctcagatcaatgatg

SEQ ID NO: 113137 - DNA, 25 bp, mus musculus
ctaggccctcagatcaatgatgatg

SEQ ID NO: 113138 - DNA, 25 bp, mus musculus
ggccctcagatcaatgatgatgttt

SEQ ID NO: 113139 - DNA, 25 bp, mus musculus
aatttcgagacagctctgcagctta

SEQ ID NO: 113140 - DNA, 25 bp, mus musculus
ccagcttccccaagatgtgattcca

SEQ ID NO: 113141 - DNA, 25 bp, mus musculus
agcttccccaagatgtgattccagc

SEQ ID NO: 113142 - DNA, 25 bp, mus musculus
ctcagattccttccttcatggtgca

SEQ ID NO: 113143 - DNA, 25 bp, mus musculus
ttccttccttcatggtgcaagatat

SEQ ID NO: 113144 - DNA, 25 bp, mus musculus
ttccttcatggtgcaagatattggt

SEQ ID NO: 113145 - DNA, 25 bp, mus musculus
gtttcatttctcctctcgttggtgc

SEQ ID NO: 113146 - DNA, 25 bp, mus musculus
ctctcgttggtgcttccagtgacaa

SEQ ID NO: 113147 - DNA, 25 bp, mus musculus
ctcgttggtgcttccagtgacaact

SEQ ID NO: 113148 - DNA, 25 bp, mus musculus
cgttggtgcttccagtgacaactct

SEQ ID NO: 113149 - DNA, 25 bp, mus musculus
ggtgcttccagtgacaactctactt

SEQ ID NO: 113150 - DNA, 25 bp, mus musculus
tgcttccagtgacaactctacttcc

SEQ ID NO: 113151 - DNA, 25 bp, mus musculus
tccagtgacaactctacttcccttc

SEQ ID NO: 113152 - DNA, 25 bp, mus musculus
cttccccaagatgtgattccagcca

SEQ ID NO: 113153 - DNA, 25 bp, mus musculus
tttctttgtggacacaacagggcat

SEQ ID NO: 113154 - DNA, 25 bp, mus musculus
tccccaagatgtgattccagccagc

SEQ ID NO: 113155 - DNA, 25 bp, mus musculus
agatgtgattccagccagccagccc

SEQ ID NO: 113156 - DNA, 25 bp, mus musculus
atgtgattccagccagccagcccat

SEQ ID NO: 113157 - DNA, 25 bp, mus musculus
gtgattccagccagccagcccatct

SEQ ID NO: 113158 - DNA, 25 bp, mus musculus
catctcttctcagattccttccttc

SEQ ID NO: 113159 - DNA, 25 bp, mus musculus
tcttctcagattccttccttcatgg

SEQ ID NO: 113160 - DNA, 25 bp, mus musculus
ttctcagattccttccttcatggtg

SEQ ID NO: 113161 - DNA, 25 bp, mus musculus
gtcactgattcggggcaaagcaagc

SEQ ID NO: 113162 - DNA, 25 bp, mus musculus
caaagcaagctctttgtcaacactc

SEQ ID NO: 113163 - DNA, 25 bp, mus musculus
ctgcgctccaggtgccacatcatct

SEQ ID NO: 113164 - DNA, 25 bp, mus musculus
tccaggtgccacatcatctcacagt

SEQ ID NO: 113165 - DNA, 25 bp, mus musculus
tgccacatcatctcacagttcaacc

SEQ ID NO: 113166 - DNA, 25 bp, mus musculus
cacatcatctcacagttcaaccaag

SEQ ID NO: 113167 - DNA, 25 bp, mus musculus
atcatctcacagttcaaccaaggct

SEQ ID NO: 113168 - DNA, 25 bp, mus musculus
cagttcaaccaaggcttgtatgatt

SEQ ID NO: 113169 - DNA, 25 bp, mus musculus
ttcaaccaaggcttgtatgattgcg

SEQ ID NO: 113170 - DNA, 25 bp, mus musculus
gattgcgtcatagcgacagatgctg

SEQ ID NO: 113171 - DNA, 25 bp, mus musculus
tgcgtcatagcgacagatgctgaaa

SEQ ID NO: 113172 - DNA, 25 bp, mus musculus
tctgatccagagtcaggtgtggctc

SEQ ID NO: 113173 - DNA, 25 bp, mus musculus
ctctttgtcaacactctagagaggg

SEQ ID NO: 113174 - DNA, 25 bp, mus musculus
cgtcttttcctggaacagttcagca

SEQ ID NO: 113175 - DNA, 25 bp, mus musculus
cttttcctggaacagttcagcattc

SEQ ID NO: 113176 - DNA, 25 bp, mus musculus
gaacagttcagcattccttcctgcg

SEQ ID NO: 113177 - DNA, 25 bp, mus musculus
cagttcagcattccttcctgcgtgc

SEQ ID NO: 113178 - DNA, 25 bp, mus musculus
ccttcctgcgtgctcaacggagaac

SEQ ID NO: 113179 - DNA, 25 bp, mus musculus
tgcgtgctcaacggagaactcccac

SEQ ID NO: 113180 - DNA, 25 bp, mus musculus
ctcaacggagaactcccactgcgct

SEQ ID NO: 113181 - DNA, 25 bp, mus musculus
agcccgttccacgatgccttccagt

SEQ ID NO: 113182 - DNA, 25 bp, mus musculus
ccgttccacgatgccttccagtacg

SEQ ID NO: 113183 - DNA, 25 bp, mus musculus
ttcagggagttcatcgggggccaca

SEQ ID NO: 113184 - DNA, 25 bp, mus musculus
gggccacaatctttctccttcgact

SEQ ID NO: 113185 - DNA, 25 bp, mus musculus
ggccacaatctttctccttcgactt

SEQ ID NO: 113186 - DNA, 25 bp, mus musculus
ccacaatctttctccttcgacttct

SEQ ID NO: 113187 - DNA, 25 bp, mus musculus
cacaatctttctccttcgacttctt

SEQ ID NO: 113188 - DNA, 25 bp, mus musculus
gagcacccgtggaagcagaagccga

SEQ ID NO: 113189 - DNA, 25 bp, mus musculus
tggcttcgcttcgttagatactgga

SEQ ID NO: 113190 - DNA, 25 bp, mus musculus
gcttcgcttcgttagatactggatt

SEQ ID NO: 113191 - DNA, 25 bp, mus musculus
cttcgcttcgttagatactggattc

SEQ ID NO: 113192 - DNA, 25 bp, mus musculus
tcgcttcgttagatactggattcac

SEQ ID NO: 113193 - DNA, 25 bp, mus musculus
gttccacgatgccttccagtacgtc

SEQ ID NO: 113194 - DNA, 25 bp, mus musculus
ttccacgatgccttccagtacgtct

SEQ ID NO: 113195 - DNA, 25 bp, mus musculus
ccacgatgccttccagtacgtcttc

SEQ ID NO: 113196 - DNA, 25 bp, mus musculus
cacgatgccttccagtacgtcttct

SEQ ID NO: 113197 - DNA, 25 bp, mus musculus
cgatgccttccagtacgtcttctcc

SEQ ID NO: 113198 - DNA, 25 bp, mus musculus
gatgccttccagtacgtcttctcct

SEQ ID NO: 113199 - DNA, 25 bp, mus musculus
tgccttccagtacgtcttctccttc

SEQ ID NO: 113200 - DNA, 25 bp, mus musculus
ttccagtacgtcttctccttccgag

SEQ ID NO: 113201 - DNA, 25 bp, mus musculus
cagcaccttgaagtctctggaagag

SEQ ID NO: 113202 - DNA, 25 bp, mus musculus
gaaggaccacatccaccgtgtcctg

SEQ ID NO: 113203 - DNA, 25 bp, mus musculus
gcatctctacaacatgaaatgcaag

SEQ ID NO: 113204 - DNA, 25 bp, mus musculus
tgtgcccctctatgacctgctcctg

SEQ ID NO: 113205 - DNA, 25 bp, mus musculus
gctcctggagatgttggatgcccac

SEQ ID NO: 113206 - DNA, 25 bp, mus musculus
cagtcgcatgggagtgcccccagag

SEQ ID NO: 113207 - DNA, 25 bp, mus musculus
cagctccacttcagcacattcctta

SEQ ID NO: 113208 - DNA, 25 bp, mus musculus
cacttcagcacattccttacaaacc

SEQ ID NO: 113209 - DNA, 25 bp, mus musculus
cacgatctgagagctcccaggctcc

SEQ ID NO: 113210 - DNA, 25 bp, mus musculus
aggttctgagaatccctgcaacatt

SEQ ID NO: 113211 - DNA, 25 bp, mus musculus
caacattttacccatgtcatgtatg

SEQ ID NO: 113212 - DNA, 25 bp, mus musculus
tttacccatgtcatgtatgactagc

SEQ ID NO: 113213 - DNA, 25 bp, mus musculus
ccacatccaccgtgtcctggacaag

SEQ ID NO: 113214 - DNA, 25 bp, mus musculus
ccaccgtgtcctggacaagatcaca

SEQ ID NO: 113215 - DNA, 25 bp, mus musculus
tttgatccacctgatggccaaagct

SEQ ID NO: 113216 - DNA, 25 bp, mus musculus
gactctgcagcagcagcatcgccgc

SEQ ID NO: 113217 - DNA, 25 bp, mus musculus
tcagctccttctcattctttcccat

SEQ ID NO: 113218 - DNA, 25 bp, mus musculus
cattctttcccatatccggcacatg

SEQ ID NO: 113219 - DNA, 25 bp, mus musculus
ttcccatatccggcacatgagtaac

SEQ ID NO: 113220 - DNA, 25 bp, mus musculus
tatccggcacatgagtaacaaaggc

SEQ ID NO: 113221 - DNA, 25 bp, mus musculus
ctgctataatttcaccatgacgaaa

SEQ ID NO: 113222 - DNA, 25 bp, mus musculus
ctataatttcaccatgacgaaacaa

SEQ ID NO: 113223 - DNA, 25 bp, mus musculus
aactcgtggactcattttgaagaca

SEQ ID NO: 113224 - DNA, 25 bp, mus musculus
gaagacataccagaaccctttccag

SEQ ID NO: 113225 - DNA, 25 bp, mus musculus
gacataccagaaccctttccagcac

SEQ ID NO: 113226 - DNA, 25 bp, mus musculus
ataccagaaccctttccagcactgc

SEQ ID NO: 113227 - DNA, 25 bp, mus musculus
tttccagcactgcccatcatgagag

SEQ ID NO: 113228 - DNA, 25 bp, mus musculus
ccagcactgcccatcatgagagcaa

SEQ ID NO: 113229 - DNA, 25 bp, mus musculus
ctgcccatcatgagagcaacagctg

SEQ ID NO: 113230 - DNA, 25 bp, mus musculus
acagctgagttctgccctcaaagaa

SEQ ID NO: 113231 - DNA, 25 bp, mus musculus
gctgagttctgccctcaaagaaggt

SEQ ID NO: 113232 - DNA, 25 bp, mus musculus
gagttctgccctcaaagaaggtcta

SEQ ID NO: 113233 - DNA, 25 bp, mus musculus
tttcaccatgacgaaacaagtatta

SEQ ID NO: 113234 - DNA, 25 bp, mus musculus
ttctgccctcaaagaaggtctaagt

SEQ ID NO: 113235 - DNA, 25 bp, mus musculus
acacctgttctgatcagaaagacat

SEQ ID NO: 113236 - DNA, 25 bp, mus musculus
aagacatcttatattcattccttta

SEQ ID NO: 113237 - DNA, 25 bp, mus musculus
acatcttatattcattcctttacct

SEQ ID NO: 113238 - DNA, 25 bp, mus musculus
tgtaagcactcagtaaactcgtgga

SEQ ID NO: 113239 - DNA, 25 bp, mus musculus
aagcactcagtaaactcgtggactc

SEQ ID NO: 113240 - DNA, 25 bp, mus musculus
cactcagtaaactcgtggactcatt

SEQ ID NO: 113241 - DNA, 25 bp, mus musculus
tcagtaaactcgtggactcattttg

SEQ ID NO: 113242 - DNA, 25 bp, mus musculus
tatgctcgtgccttcctgatggagc

SEQ ID NO: 113243 - DNA, 25 bp, mus musculus
gctcgtgccttcctgatggagcagg

SEQ ID NO: 113244 - DNA, 25 bp, mus musculus
gtcactgcactgctgtccctggctc

SEQ ID NO: 113245 - DNA, 25 bp, mus musculus
gctctgggccagccagtgttgcaga

SEQ ID NO: 113246 - DNA, 25 bp, mus musculus
ctgggccagccagtgttgcagaacc

SEQ ID NO: 113247 - DNA, 25 bp, mus musculus
gtgttgcagaacctggctatgactg

SEQ ID NO: 113248 - DNA, 25 bp, mus musculus
gtctccctcactggcaaggtgttgc

SEQ ID NO: 113249 - DNA, 25 bp, mus musculus
tccctcactggcaaggtgttgcctg

SEQ ID NO: 113250 - DNA, 25 bp, mus musculus
attgcggctaagcgtgcaggtgtga

SEQ ID NO: 113251 - DNA, 25 bp, mus musculus
gcggctaagcgtgcaggtgtgacct

SEQ ID NO: 113252 - DNA, 25 bp, mus musculus
aagcgtgcaggtgtgacctgcatca

SEQ ID NO: 113253 - DNA, 25 bp, mus musculus
ggtgtgacctgcatcattctgcctg

SEQ ID NO: 113254 - DNA, 25 bp, mus musculus
aatgacttcctagtcacctcacaca

SEQ ID NO: 113255 - DNA, 25 bp, mus musculus
gtgacctgcatcattctgcctgctg

SEQ ID NO: 113256 - DNA, 25 bp, mus musculus
cacctgcatgtgcctgagggtgcta

SEQ ID NO: 113257 - DNA, 25 bp, mus musculus
acccccaaggatggtcccagcgcag

SEQ ID NO: 113258 - DNA, 25 bp, mus musculus
aaggatggtcccagcgcaggctgta

SEQ ID NO: 113259 - DNA, 25 bp, mus musculus
ggtcccagcgcaggctgtactattg

SEQ ID NO: 113260 - DNA, 25 bp, mus musculus
agcgcaggctgtactattgtcactg

SEQ ID NO: 113261 - DNA, 25 bp, mus musculus
actattgtcactgcactgctgtccc

SEQ ID NO: 113262 - DNA, 25 bp, mus musculus
attgtcactgcactgctgtccctgg

SEQ ID NO: 113263 - DNA, 25 bp, mus musculus
gtggcaccctcttgacatgagcgtc

SEQ ID NO: 113264 - DNA, 25 bp, mus musculus
gcaccctcttgacatgagcgtcgct

SEQ ID NO: 113265 - DNA, 25 bp, mus musculus
catctcctctgggatccatcttaag

SEQ ID NO: 113266 - DNA, 25 bp, mus musculus
ctctgggatccatcttaagcacatc

SEQ ID NO: 113267 - DNA, 25 bp, mus musculus
tgggatccatcttaagcacatcacc

SEQ ID NO: 113268 - DNA, 25 bp, mus musculus
tcttaagcacatcaccagcctggag

SEQ ID NO: 113269 - DNA, 25 bp, mus musculus
taagcacatcaccagcctggaggtg

SEQ ID NO: 113270 - DNA, 25 bp, mus musculus
gcacatcaccagcctggaggtgatc

SEQ ID NO: 113271 - DNA, 25 bp, mus musculus
caccagcctggaggtgatcaaggca

SEQ ID NO: 113272 - DNA, 25 bp, mus musculus
cagcctggaggtgatcaaggcagga

SEQ ID NO: 113273 - DNA, 25 bp, mus musculus
caaggcaggacgccactgtgcggtt

SEQ ID NO: 113274 - DNA, 25 bp, mus musculus
aggacgccactgtgcggttccccag

SEQ ID NO: 113275 - DNA, 25 bp, mus musculus
ccctcttgacatgagcgtcgctgcg

SEQ ID NO: 113276 - DNA, 25 bp, mus musculus
tgacatgagcgtcgctgcggtgttt

SEQ ID NO: 113277 - DNA, 25 bp, mus musculus
gcttctgggcctgttgtttctgcca

SEQ ID NO: 113278 - DNA, 25 bp, mus musculus
ggttgctgtcaccagcgctggtccc

SEQ ID NO: 113279 - DNA, 25 bp, mus musculus
tgctgtcaccagcgctggtcccgaa

SEQ ID NO: 113280 - DNA, 25 bp, mus musculus
tgtcaccagcgctggtcccgaagaa

SEQ ID NO: 113281 - DNA, 25 bp, mus musculus
cagcgctggtcccgaagaaagcgat

SEQ ID NO: 113282 - DNA, 25 bp, mus musculus
gaccatctcctctgggatccatctt

SEQ ID NO: 113283 - DNA, 25 bp, mus musculus
agccagtctctgtgcctcagtaagc

SEQ ID NO: 113284 - DNA, 25 bp, mus musculus
tctctgtgcctcagtaagctgacca

SEQ ID NO: 113285 - DNA, 25 bp, mus musculus
gtactggctggcttcactggaagcg

SEQ ID NO: 113286 - DNA, 25 bp, mus musculus
ttcactggaagcggaccaatccagt

SEQ ID NO: 113287 - DNA, 25 bp, mus musculus
gagctactctctgacaagtcctgtc

SEQ ID NO: 113288 - DNA, 25 bp, mus musculus
ctctctgacaagtcctgtcaatctt

SEQ ID NO: 113289 - DNA, 25 bp, mus musculus
tcctgtcaatctttcatcagctgga

SEQ ID NO: 113290 - DNA, 25 bp, mus musculus
gtatgtgacctgcagaacttgctgg

SEQ ID NO: 113291 - DNA, 25 bp, mus musculus
cagaacttgctgggcttcactccgg

SEQ ID NO: 113292 - DNA, 25 bp, mus musculus
ttgctgggcttcactccggaggaac

SEQ ID NO: 113293 - DNA, 25 bp, mus musculus
ggcttcactccggaggaactgcatg

SEQ ID NO: 113294 - DNA, 25 bp, mus musculus
gtccagcctgatacagaagactgag

SEQ ID NO: 113295 - DNA, 25 bp, mus musculus
tgcctcagtaagctgaccatgtcct

SEQ ID NO: 113296 - DNA, 25 bp, mus musculus
atgtccttcaaggactacatccaag

SEQ ID NO: 113297 - DNA, 25 bp, mus musculus
ttcaaggactacatccaagagagga

SEQ ID NO: 113298 - DNA, 25 bp, mus musculus
gactacatccaagagaggagcgacc

SEQ ID NO: 113299 - DNA, 25 bp, mus musculus
agcgacccagtcgagcaaggcaaac

SEQ ID NO: 113300 - DNA, 25 bp, mus musculus
ccagttattcctgcagcagtactgg

SEQ ID NO: 113301 - DNA, 25 bp, mus musculus
attcctgcagcagtactggctggct

SEQ ID NO: 113302 - DNA, 25 bp, mus musculus
gcagcagtactggctggcttcactg

SEQ ID NO: 113303 - DNA, 25 bp, mus musculus
ttctatcaactgtggttctggcaaa

SEQ ID NO: 113304 - DNA, 25 bp, mus musculus
tctcatctctcaaaaggtcaaagca

SEQ ID NO: 113305 - DNA, 25 bp, mus musculus
tcaactaggctgtgggttggaaagg

SEQ ID NO: 113306 - DNA, 25 bp, mus musculus
cacgtttgctcagatgatccaaagt

SEQ ID NO: 113307 - DNA, 25 bp, mus musculus
tttgtttagcgtcagaccagaaagg

SEQ ID NO: 113308 - DNA, 25 bp, mus musculus
tagcgtcagaccagaaagggagatg

SEQ ID NO: 113309 - DNA, 25 bp, mus musculus
gtatgcttgctcaaggtttatatct

SEQ ID NO: 113310 - DNA, 25 bp, mus musculus
aattaaacattcctgttcagcagtg

SEQ ID NO: 113311 - DNA, 25 bp, mus musculus
gaatgacctctgtctgaatgtactt

SEQ ID NO: 113312 - DNA, 25 bp, mus musculus
cctctgtctgaatgtacttgaactt

SEQ ID NO: 113313 - DNA, 25 bp, mus musculus
tttaagcccttagagccaagcagat

SEQ ID NO: 113314 - DNA, 25 bp, mus musculus
cccttagagccaagcagatgtcaaa

SEQ ID NO: 113315 - DNA, 25 bp, mus musculus
gtgactttctggcaagtagtgggct

SEQ ID NO: 113316 - DNA, 25 bp, mus musculus
tctggactgctgagtcggacacttg

SEQ ID NO: 113317 - DNA, 25 bp, mus musculus
ctgctgagtcggacacttggaaaag

SEQ ID NO: 113318 - DNA, 25 bp, mus musculus
aggagctcacaggctccaacctcct

SEQ ID NO: 113319 - DNA, 25 bp, mus musculus
tcacaggctccaacctcctattgca

SEQ ID NO: 113320 - DNA, 25 bp, mus musculus
acctcctattgcaatctcctggtgt

SEQ ID NO: 113321 - DNA, 25 bp, mus musculus
aatctcctggtgtgcttacagcagc

SEQ ID NO: 113322 - DNA, 25 bp, mus musculus
tgcttacagcagccagggagagaaa

SEQ ID NO: 113323 - DNA, 25 bp, mus musculus
ggctgctcactgcttccccagagaa

SEQ ID NO: 113324 - DNA, 25 bp, mus musculus
tcactgcttccccagagaacacagc

SEQ ID NO: 113325 - DNA, 25 bp, mus musculus
ggtccacacagtggctcagatcatc

SEQ ID NO: 113326 - DNA, 25 bp, mus musculus
ccacacagtggctcagatcatcacc

SEQ ID NO: 113327 - DNA, 25 bp, mus musculus
agtggctcagatcatcacccactca

SEQ ID NO: 113328 - DNA, 25 bp, mus musculus
ggctcagatcatcacccactcaagc

SEQ ID NO: 113329 - DNA, 25 bp, mus musculus
tcagatcatcacccactcaagctac

SEQ ID NO: 113330 - DNA, 25 bp, mus musculus
ccactcaagctaccgagaagagggc

SEQ ID NO: 113331 - DNA, 25 bp, mus musculus
ctcaagctaccgagaagagggctcc

SEQ ID NO: 113332 - DNA, 25 bp, mus musculus
tcccaacggccttcactgtactgtc

SEQ ID NO: 113333 - DNA, 25 bp, mus musculus
caacggccttcactgtactgtcacg

SEQ ID NO: 113334 - DNA, 25 bp, mus musculus
cggccttcactgtactgtcacggga

SEQ ID NO: 113335 - DNA, 25 bp, mus musculus
cttccccagagaacacagcagggaa

SEQ ID NO: 113336 - DNA, 25 bp, mus musculus
ccccagagaacacagcagggaagcg

SEQ ID NO: 113337 - DNA, 25 bp, mus musculus
ccaccagctagactcctacagcaat

SEQ ID NO: 113338 - DNA, 25 bp, mus musculus
gctagactcctacagcaatgacact

SEQ ID NO: 113339 - DNA, 25 bp, mus musculus
ctcctacagcaatgacactgtggtc

SEQ ID NO: 113340 - DNA, 25 bp, mus musculus
caatgacactgtggtccacacagtg

SEQ ID NO: 113341 - DNA, 25 bp, mus musculus
cactgtggtccacacagtggctcag

SEQ ID NO: 113342 - DNA, 25 bp, mus musculus
tgtggtccacacagtggctcagatc

SEQ ID NO: 113343 - DNA, 25 bp, mus musculus
actcgcacgtgccgctgcactacta

SEQ ID NO: 113344 - DNA, 25 bp, mus musculus
tggacaccttccgtgcgctttcaca

SEQ ID NO: 113345 - DNA, 25 bp, mus musculus
gttgtcacagcagccagtctgcagc

SEQ ID NO: 113346 - DNA, 25 bp, mus musculus
gtcacagcagccagtctgcagcggc

SEQ ID NO: 113347 - DNA, 25 bp, mus musculus
acagcagccagtctgcagcggcggc

SEQ ID NO: 113348 - DNA, 25 bp, mus musculus
ccgctgcagcggcagcgctgggctc

SEQ ID NO: 113349 - DNA, 25 bp, mus musculus
gtggctcggactttggctgcagcgc

SEQ ID NO: 113350 - DNA, 25 bp, mus musculus
actttggctgcagcgccgcggcgcc

SEQ ID NO: 113351 - DNA, 25 bp, mus musculus
gctccgagagcggcttcttgcccta

SEQ ID NO: 113352 - DNA, 25 bp, mus musculus
agagcggcttcttgccctattccgc

SEQ ID NO: 113353 - DNA, 25 bp, mus musculus
cggtgctcagcaagaccgccgtcag

SEQ ID NO: 113354 - DNA, 25 bp, mus musculus
tcagcccgccggaccagagggacga

SEQ ID NO: 113355 - DNA, 25 bp, mus musculus
ccttccgtgcgctttcacatcctta

SEQ ID NO: 113356 - DNA, 25 bp, mus musculus
tccgtgcgctttcacatccttattc

SEQ ID NO: 113357 - DNA, 25 bp, mus musculus
gtgcgctttcacatccttattcgcg

SEQ ID NO: 113358 - DNA, 25 bp, mus musculus
cgctttcacatccttattcgcggcc

SEQ ID NO: 113359 - DNA, 25 bp, mus musculus
cacatccttattcgcggccggaact

SEQ ID NO: 113360 - DNA, 25 bp, mus musculus
atccttattcgcggccggaactgct

SEQ ID NO: 113361 - DNA, 25 bp, mus musculus
cctgctcgtgcctcagttgtcacag

SEQ ID NO: 113362 - DNA, 25 bp, mus musculus
cgtgcctcagttgtcacagcagcca

SEQ ID NO: 113363 - DNA, 25 bp, mus musculus
ctacgaacgtgccccaagagacatc

SEQ ID NO: 113364 - DNA, 25 bp, mus musculus
acgtgccccaagagacatctgtaac

SEQ ID NO: 113365 - DNA, 25 bp, mus musculus
attttgatgcgtacacaaggtcact

SEQ ID NO: 113366 - DNA, 25 bp, mus musculus
atgcgtacacaaggtcactgttgat

SEQ ID NO: 113367 - DNA, 25 bp, mus musculus
ttgtttagtggcttggcagctcttt

SEQ ID NO: 113368 - DNA, 25 bp, mus musculus
agtggcttggcagctctttgtaaaa

SEQ ID NO: 113369 - DNA, 25 bp, mus musculus
ttggcagctctttgtaaaagcatat

SEQ ID NO: 113370 - DNA, 25 bp, mus musculus
ggcatttgcctatttttcaaattat

SEQ ID NO: 113371 - DNA, 25 bp, mus musculus
ccagtgcatgtctgccctctgagat

SEQ ID NO: 113372 - DNA, 25 bp, mus musculus
catgtctgccctctgagatgcaata

SEQ ID NO: 113373 - DNA, 25 bp, mus musculus
gtctgccctctgagatgcaataaac

SEQ ID NO: 113374 - DNA, 25 bp, mus musculus
tgccctctgagatgcaataaacacc

SEQ ID NO: 113375 - DNA, 25 bp, mus musculus
acgtacatctgttcagttagtattt

SEQ ID NO: 113376 - DNA, 25 bp, mus musculus
agtagtgtttctccatccttcaatt

SEQ ID NO: 113377 - DNA, 25 bp, mus musculus
gtttctccatccttcaattgagctc

SEQ ID NO: 113378 - DNA, 25 bp, mus musculus
ccatccttcaattgagctcaaagtg

SEQ ID NO: 113379 - DNA, 25 bp, mus musculus
gacttctattgtacctttgtgatag

SEQ ID NO: 113380 - DNA, 25 bp, mus musculus
tattgtacctttgtgataggattga

SEQ ID NO: 113381 - DNA, 25 bp, mus musculus
atactgtctgtgccgatggcttggc

SEQ ID NO: 113382 - DNA, 25 bp, mus musculus
tctgtgccgatggcttggctgaaga

SEQ ID NO: 113383 - DNA, 25 bp, mus musculus
atactgtaccaaagtttttgatatg

SEQ ID NO: 113384 - DNA, 25 bp, mus musculus
ttttgatatgctcacagtagcagct

SEQ ID NO: 113385 - DNA, 25 bp, mus musculus
tatcaaaacactggatcaaattcga

SEQ ID NO: 113386 - DNA, 25 bp, mus musculus
ggatcaaattcgaactattgaacga

SEQ ID NO: 113387 - DNA, 25 bp, mus musculus
tcaggaaattcctcacaaaggagca

SEQ ID NO: 113388 - DNA, 25 bp, mus musculus
aattcctcacaaaggagcattttgt

SEQ ID NO: 113389 - DNA, 25 bp, mus musculus
tcctcacaaaggagcattttgtgac

SEQ ID NO: 113390 - DNA, 25 bp, mus musculus
agcattttgtgacttggtgtggtca

SEQ ID NO: 113391 - DNA, 25 bp, mus musculus
gtcagatcctgaagatgtggacact

SEQ ID NO: 113392 - DNA, 25 bp, mus musculus
ttgggcaatcagtcccagaggagca

SEQ ID NO: 113393 - DNA, 25 bp, mus musculus
ggcaatcagtcccagaggagcaggt

SEQ ID NO: 113394 - DNA, 25 bp, mus musculus
aatcagtcccagaggagcaggttgg

SEQ ID NO: 113395 - DNA, 25 bp, mus musculus
tgatatgctcacagtagcagcttta

SEQ ID NO: 113396 - DNA, 25 bp, mus musculus
gctcacagtagcagctttaatagat

SEQ ID NO: 113397 - DNA, 25 bp, mus musculus
gattttgtgtgttcatggcggttta

SEQ ID NO: 113398 - DNA, 25 bp, mus musculus
tgttcatggcggtttatctcctgat

SEQ ID NO: 113399 - DNA, 25 bp, mus musculus
tcatggcggtttatctcctgatatc

SEQ ID NO: 113400 - DNA, 25 bp, mus musculus
cggtttatctcctgatatcaaaaca

SEQ ID NO: 113401 - DNA, 25 bp, mus musculus
tttatctcctgatatcaaaacactg

SEQ ID NO: 113402 - DNA, 25 bp, mus musculus
atctcctgatatcaaaacactggat

SEQ ID NO: 113403 - DNA, 25 bp, mus musculus
atctgcgggccatgctcctgactga

SEQ ID NO: 113404 - DNA, 25 bp, mus musculus
acccacgactggctctgagcatctt

SEQ ID NO: 113405 - DNA, 25 bp, mus musculus
tcttgattttcctgtaagtgaaaga

SEQ ID NO: 113406 - DNA, 25 bp, mus musculus
tccaactcctctaatgtaacaactt

SEQ ID NO: 113407 - DNA, 25 bp, mus musculus
acaactttgtcttcataatcataaa

SEQ ID NO: 113408 - DNA, 25 bp, mus musculus
ttgtcttcataatcataaaccatat

SEQ ID NO: 113409 - DNA, 25 bp, mus musculus
ttccggttcacctcactggcagctt

SEQ ID NO: 113410 - DNA, 25 bp, mus musculus
ttcacctcactggcagcttggtatt

SEQ ID NO: 113411 - DNA, 25 bp, mus musculus
gtctcttgcagctccattaggttta

SEQ ID NO: 113412 - DNA, 25 bp, mus musculus
taaggtccagcacttttgttcactt

SEQ ID NO: 113413 - DNA, 25 bp, mus musculus
ccagcacttttgttcacttaaaatg

SEQ ID NO: 113414 - DNA, 25 bp, mus musculus
actctgagcattctttcgccctaaa

SEQ ID NO: 113415 - DNA, 25 bp, mus musculus
ctctgagcatcttctttggcccatg

SEQ ID NO: 113416 - DNA, 25 bp, mus musculus
gcctgactggtccaggaaaatggga

SEQ ID NO: 113417 - DNA, 25 bp, mus musculus
tcttgacccagtgggaccgaacagt

SEQ ID NO: 113418 - DNA, 25 bp, mus musculus
tgaaagtcaccaaaactcgaaccat

SEQ ID NO: 113419 - DNA, 25 bp, mus musculus
tcaccaaaactcgaaccatacaaga

SEQ ID NO: 113420 - DNA, 25 bp, mus musculus
tacaagaatccccatcttcctttga

SEQ ID NO: 113421 - DNA, 25 bp, mus musculus
tgctgaaactctttagttttctggc

SEQ ID NO: 113422 - DNA, 25 bp, mus musculus
ttctggctttgctcatagctgtctt

SEQ ID NO: 113423 - DNA, 25 bp, mus musculus
ggccagcttcctgaggagctgtttc

SEQ ID NO: 113424 - DNA, 25 bp, mus musculus
gtcatggctgcccaagaaaaggaca

SEQ ID NO: 113425 - DNA, 25 bp, mus musculus
ggctttgtgtgcctagcaagttact

SEQ ID NO: 113426 - DNA, 25 bp, mus musculus
tagtgccctccaattccatccatta

SEQ ID NO: 113427 - DNA, 25 bp, mus musculus
cctccaattccatccattattgcct

SEQ ID NO: 113428 - DNA, 25 bp, mus musculus
tccattattgcctcgaatgagaaaa

SEQ ID NO: 113429 - DNA, 25 bp, mus musculus
gagaaaacttcatccttaaggctgg

SEQ ID NO: 113430 - DNA, 25 bp, mus musculus
acttcatccttaaggctggaggaga

SEQ ID NO: 113431 - DNA, 25 bp, mus musculus
aatctttctttatgcatctgtcagt

SEQ ID NO: 113432 - DNA, 25 bp, mus musculus
tgcatctgtcagttgctagataatg

SEQ ID NO: 113433 - DNA, 25 bp, mus musculus
tcattttcctggctgttctaggtat

SEQ ID NO: 113434 - DNA, 25 bp, mus musculus
tcctggctgttctaggtatagtgcc

SEQ ID NO: 113435 - DNA, 25 bp, mus musculus
ccactgctaaccgctgagcagaacc

SEQ ID NO: 113436 - DNA, 25 bp, mus musculus
agtgccaataaactcaggaggacag

SEQ ID NO: 113437 - DNA, 25 bp, mus musculus
ctccacctcgttctgcaggaaacca

SEQ ID NO: 113438 - DNA, 25 bp, mus musculus
ctcgttctgcaggaaaccatctctc

SEQ ID NO: 113439 - DNA, 25 bp, mus musculus
ccctctggacagggtgtctgataag

SEQ ID NO: 113440 - DNA, 25 bp, mus musculus
tgataagtcaccttcttaccaactt

SEQ ID NO: 113441 - DNA, 25 bp, mus musculus
tgttttatctttggggacaggtgat

SEQ ID NO: 113442 - DNA, 25 bp, mus musculus
atctttggggacaggtgatgaaaca

SEQ ID NO: 113443 - DNA, 25 bp, mus musculus
tgaaacatctgatctagcttctgtt

SEQ ID NO: 113444 - DNA, 25 bp, mus musculus
cggaaccagttgacgccatcaacac

SEQ ID NO: 113445 - DNA, 25 bp, mus musculus
aaccagttgacgccatcaacacaga

SEQ ID NO: 113446 - DNA, 25 bp, mus musculus
ccatcccggcagatgcaggagaaag

SEQ ID NO: 113447 - DNA, 25 bp, mus musculus
acgcaggtgcctccattcacacagg

SEQ ID NO: 113448 - DNA, 25 bp, mus musculus
caggtgcctccattcacacagggat

SEQ ID NO: 113449 - DNA, 25 bp, mus musculus
cctccattcacacagggattgggca

SEQ ID NO: 113450 - DNA, 25 bp, mus musculus
ccattcacacagggattgggcacac

SEQ ID NO: 113451 - DNA, 25 bp, mus musculus
ttcacacagggattgggcacacagc

SEQ ID NO: 113452 - DNA, 25 bp, mus musculus
ttgggcacacagctgctgttcttgg

SEQ ID NO: 113453 - DNA, 25 bp, mus musculus
ttcttggcgatggtgcaggtgctgc

SEQ ID NO: 113454 - DNA, 25 bp, mus musculus
gccgctgtcatagcatgtgccaccg

SEQ ID NO: 113455 - DNA, 25 bp, mus musculus
gtcatagcatgtgccaccgttgctg

SEQ ID NO: 113456 - DNA, 25 bp, mus musculus
cagttgacgccatcaacacagatgc

SEQ ID NO: 113457 - DNA, 25 bp, mus musculus
acgccatcaacacagatgcctccgt

SEQ ID NO: 113458 - DNA, 25 bp, mus musculus
ccatcaacacagatgcctccgttat

SEQ ID NO: 113459 - DNA, 25 bp, mus musculus
tcaacacagatgcctccgttatagc

SEQ ID NO: 113460 - DNA, 25 bp, mus musculus
cagatgcctccgttatagcagggca

SEQ ID NO: 113461 - DNA, 25 bp, mus musculus
atgcctccgttatagcagggcagag

SEQ ID NO: 113462 - DNA, 25 bp, mus musculus
cctccgttatagcagggcagagggt

SEQ ID NO: 113463 - DNA, 25 bp, mus musculus
ttatagcagggcagagggttgcagt

SEQ ID NO: 113464 - DNA, 25 bp, mus musculus
aaactgacaatcacacaggatggaa

SEQ ID NO: 113465 - DNA, 25 bp, mus musculus
gaatcaagcaacttcagaaacattg

SEQ ID NO: 113466 - DNA, 25 bp, mus musculus
gaataagtcaacttctcagagcctg

SEQ ID NO: 113467 - DNA, 25 bp, mus musculus
gtcaacttctcagagcctggagcaa

SEQ ID NO: 113468 - DNA, 25 bp, mus musculus
ttctcagagcctggagcaacgctga

SEQ ID NO: 113469 - DNA, 25 bp, mus musculus
ctttctccatcatgctaatgccagg

SEQ ID NO: 113470 - DNA, 25 bp, mus musculus
ccatcatgctaatgccaggctcatt

SEQ ID NO: 113471 - DNA, 25 bp, mus musculus
tgctaatgccaggctcattcgtcat

SEQ ID NO: 113472 - DNA, 25 bp, mus musculus
tgccaggctcattcgtcatcctatc

SEQ ID NO: 113473 - DNA, 25 bp, mus musculus
tcgtcatcctatcagcactggtctc

SEQ ID NO: 113474 - DNA, 25 bp, mus musculus
tcctatcagcactggtctccagcct

SEQ ID NO: 113475 - DNA, 25 bp, mus musculus
ttatggtccttaagctatacatgaa

SEQ ID NO: 113476 - DNA, 25 bp, mus musculus
agcaacttcagaaacattgatgttg

SEQ ID NO: 113477 - DNA, 25 bp, mus musculus
agtctagcagacggaacggagctca

SEQ ID NO: 113478 - DNA, 25 bp, mus musculus
gagctcactggggcctggaccattg

SEQ ID NO: 113479 - DNA, 25 bp, mus musculus
gagctgattgctgtccgagaggttt

SEQ ID NO: 113480 - DNA, 25 bp, mus musculus
attgctgtccgagaggtttctggta

SEQ ID NO: 113481 - DNA, 25 bp, mus musculus
aatgaactaatccagacctacacat

SEQ ID NO: 113482 - DNA, 25 bp, mus musculus
ctaatccagacctacacatatgaag

SEQ ID NO: 113483 - DNA, 25 bp, mus musculus
cagacctacacatatgaaggagttg

SEQ ID NO: 113484 - DNA, 25 bp, mus musculus
ggctgtaccgtacagatgagcacct

SEQ ID NO: 113485 - DNA, 25 bp, mus musculus
accggtgactgtcgctcagtgaggc

SEQ ID NO: 113486 - DNA, 25 bp, mus musculus
tgccccatgtgaaatcagcttcaat

SEQ ID NO: 113487 - DNA, 25 bp, mus musculus
cttcaattctcacagtaggacattt

SEQ ID NO: 113488 - DNA, 25 bp, mus musculus
ttctcacagtaggacatttgatgac

SEQ ID NO: 113489 - DNA, 25 bp, mus musculus
gtcatgaaggcctgggttttctctt

SEQ ID NO: 113490 - DNA, 25 bp, mus musculus
aaggcctgggttttctcttgcatct

SEQ ID NO: 113491 - DNA, 25 bp, mus musculus
tgggttttctcttgcatctgcacat

SEQ ID NO: 113492 - DNA, 25 bp, mus musculus
ttctcttgcatctgcacatccaggc

SEQ ID NO: 113493 - DNA, 25 bp, mus musculus
tgcatctgcacatccaggctttgcc

SEQ ID NO: 113494 - DNA, 25 bp, mus musculus
tgcacatccaggctttgccgggcaa

SEQ ID NO: 113495 - DNA, 25 bp, mus musculus
cgggcaaacactgactggcagtgga

SEQ ID NO: 113496 - DNA, 25 bp, mus musculus
gactgtcgctcagtgaggcctttgt

SEQ ID NO: 113497 - DNA, 25 bp, mus musculus
cgctcagtgaggcctttgttcctca

SEQ ID NO: 113498 - DNA, 25 bp, mus musculus
gtgaggcctttgttcctcagtgcag

SEQ ID NO: 113499 - DNA, 25 bp, mus musculus
ttcctcagtgcagaaatgctgcaag

SEQ ID NO: 113500 - DNA, 25 bp, mus musculus
ctgcaaggcaccactatagtggaag

SEQ ID NO: 113501 - DNA, 25 bp, mus musculus
catctgcttccctatgtctagtaaa

SEQ ID NO: 113502 - DNA, 25 bp, mus musculus
atggctgttgttttctagtgagaat

SEQ ID NO: 113503 - DNA, 25 bp, mus musculus
ctgcacatctgctatgagaaccctt

SEQ ID NO: 113504 - DNA, 25 bp, mus musculus
gcagcgtcgcccatactccgagcaa

SEQ ID NO: 113505 - DNA, 25 bp, mus musculus
cgtcgcccatactccgagcaaagaa

SEQ ID NO: 113506 - DNA, 25 bp, mus musculus
catactccaaggaagcatcatcagc

SEQ ID NO: 113507 - DNA, 25 bp, mus musculus
tactccaaggaagcatcatcagcat

SEQ ID NO: 113508 - DNA, 25 bp, mus musculus
ggaagcatcatcagcatcaccacca

SEQ ID NO: 113509 - DNA, 25 bp, mus musculus
aagcatcatcagcatcaccaccagc

SEQ ID NO: 113510 - DNA, 25 bp, mus musculus
gcatcatcagcatcaccaccagcag

SEQ ID NO: 113511 - DNA, 25 bp, mus musculus
cccaccaatacctgcaaatggccag

SEQ ID NO: 113512 - DNA, 25 bp, mus musculus
ccaatacctgcaaatggccagcagg

SEQ ID NO: 113513 - DNA, 25 bp, mus musculus
tacctgcaaatggccagcaggccag

SEQ ID NO: 113514 - DNA, 25 bp, mus musculus
gccagcaggccagcagccagaatga

SEQ ID NO: 113515 - DNA, 25 bp, mus musculus
cagcaggccagcagccagaatgaag

SEQ ID NO: 113516 - DNA, 25 bp, mus musculus
gcccatactccgagcaaagaactgt

SEQ ID NO: 113517 - DNA, 25 bp, mus musculus
aggccagcagccagaatgaaggctt

SEQ ID NO: 113518 - DNA, 25 bp, mus musculus
ccatactccgagcaaagaactgtgg

SEQ ID NO: 113519 - DNA, 25 bp, mus musculus
atactccgagcaaagaactgtggcc

SEQ ID NO: 113520 - DNA, 25 bp, mus musculus
actccgagcaaagaactgtggccag

SEQ ID NO: 113521 - DNA, 25 bp, mus musculus
caaagaactgtggccagaggaggtc

SEQ ID NO: 113522 - DNA, 25 bp, mus musculus
agacactttgctgtgttcaaatcca

SEQ ID NO: 113523 - DNA, 25 bp, mus musculus
cagaatcatactccaaggaagcatc

SEQ ID NO: 113524 - DNA, 25 bp, mus musculus
atcatactccaaggaagcatcatca

SEQ ID NO: 113525 - DNA, 25 bp, mus musculus
gccctacacatttgatatcaacctg

SEQ ID NO: 113526 - DNA, 25 bp, mus musculus
cacatttgatatcaacctgtctgtc

SEQ ID NO: 113527 - DNA, 25 bp, mus musculus
aagctttggctccatgctggaactg

SEQ ID NO: 113528 - DNA, 25 bp, mus musculus
tggctccatgctggaactgtcctgg

SEQ ID NO: 113529 - DNA, 25 bp, mus musculus
gaccttcctgctggacggcgatgaa

SEQ ID NO: 113530 - DNA, 25 bp, mus musculus
cctgctggacggcgatgaagtcatc

SEQ ID NO: 113531 - DNA, 25 bp, mus musculus
agtcatcataacaggtcactgccag

SEQ ID NO: 113532 - DNA, 25 bp, mus musculus
cataacaggtcactgccagggggac

SEQ ID NO: 113533 - DNA, 25 bp, mus musculus
accagcctgaagctccggaagtcac

SEQ ID NO: 113534 - DNA, 25 bp, mus musculus
acacccttgccttatgaggatcatg

SEQ ID NO: 113535 - DNA, 25 bp, mus musculus
gatcatgctaccactgcatcagtca

SEQ ID NO: 113536 - DNA, 25 bp, mus musculus
actgcatcagtcaggaatgaataaa

SEQ ID NO: 113537 - DNA, 25 bp, mus musculus
aatgagccaggcggctaccatctgc

SEQ ID NO: 113538 - DNA, 25 bp, mus musculus
catctgcaggtctaactttaagcac

SEQ ID NO: 113539 - DNA, 25 bp, mus musculus
taagcacatgtactggaccatgctg

SEQ ID NO: 113540 - DNA, 25 bp, mus musculus
catgtactggaccatgctgcagcaa

SEQ ID NO: 113541 - DNA, 25 bp, mus musculus
ctggaccatgctgcagcaactcaca

SEQ ID NO: 113542 - DNA, 25 bp, mus musculus
gcagcaactcacacaccactctgtt

SEQ ID NO: 113543 - DNA, 25 bp, mus musculus
acaccactctgttaatggatgcaac

SEQ ID NO: 113544 - DNA, 25 bp, mus musculus
ttctggaaccatcagtggatcagac

SEQ ID NO: 113545 - DNA, 25 bp, mus musculus
aggcttctctgttgttctccgcagg

SEQ ID NO: 113546 - DNA, 25 bp, mus musculus
gacacgccgaatgtgaccgcaacca

SEQ ID NO: 113547 - DNA, 25 bp, mus musculus
gctccctcaggtataagtattgttt

SEQ ID NO: 113548 - DNA, 25 bp, mus musculus
ttgtttaaactgcatcaatggagca

SEQ ID NO: 113549 - DNA, 25 bp, mus musculus
tttaaactgcatcaatggagcacat

SEQ ID NO: 113550 - DNA, 25 bp, mus musculus
taaactgcatcaatggagcacatac

SEQ ID NO: 113551 - DNA, 25 bp, mus musculus
gagcacatacagggagcctgctttg

SEQ ID NO: 113552 - DNA, 25 bp, mus musculus
agcacatacagggagcctgctttgg

SEQ ID NO: 113553 - DNA, 25 bp, mus musculus
cacatacagggagcctgctttggta

SEQ ID NO: 113554 - DNA, 25 bp, mus musculus
acatacagggagcctgctttggtac

SEQ ID NO: 113555 - DNA, 25 bp, mus musculus
tacagggagcctgctttggtactac

SEQ ID NO: 113556 - DNA, 25 bp, mus musculus
ggagcctgctttggtactacagaac

SEQ ID NO: 113557 - DNA, 25 bp, mus musculus
acacgccgaatgtgaccgcaaccaa

SEQ ID NO: 113558 - DNA, 25 bp, mus musculus
gagcctgctttggtactacagaact

SEQ ID NO: 113559 - DNA, 25 bp, mus musculus
ccgaatgtgaccgcaaccaacgcgt

SEQ ID NO: 113560 - DNA, 25 bp, mus musculus
aatgtgaccgcaaccaacgcgttct

SEQ ID NO: 113561 - DNA, 25 bp, mus musculus
atgtgaccgcaaccaacgcgttctc

SEQ ID NO: 113562 - DNA, 25 bp, mus musculus
gtgaccgcaaccaacgcgttctctc

SEQ ID NO: 113563 - DNA, 25 bp, mus musculus
tgaccgcaaccaacgcgttctctca

SEQ ID NO: 113564 - DNA, 25 bp, mus musculus
gcccggctccctcaggtataagtat

SEQ ID NO: 113565 - DNA, 25 bp, mus musculus
cggctccctcaggtataagtattgt

SEQ ID NO: 113566 - DNA, 25 bp, mus musculus
tcacacgctctctggatttcccact

SEQ ID NO: 113567 - DNA, 25 bp, mus musculus
cacacgctctctggatttcccactg

SEQ ID NO: 113568 - DNA, 25 bp, mus musculus
tcacttccaaggatacgatgagagg

SEQ ID NO: 113569 - DNA, 25 bp, mus musculus
cacttccaaggatacgatgagaggt

SEQ ID NO: 113570 - DNA, 25 bp, mus musculus
acttccaaggatacgatgagaggtt

SEQ ID NO: 113571 - DNA, 25 bp, mus musculus
tctctcagctgtctggagtccatga

SEQ ID NO: 113572 - DNA, 25 bp, mus musculus
ctctcagctgtctggagtccatgaa

SEQ ID NO: 113573 - DNA, 25 bp, mus musculus
tctcagctgtctggagtccatgaat

SEQ ID NO: 113574 - DNA, 25 bp, mus musculus
ctcagctgtctggagtccatgaatt

SEQ ID NO: 113575 - DNA, 25 bp, mus musculus
tcagctgtctggagtccatgaattc

SEQ ID NO: 113576 - DNA, 25 bp, mus musculus
cagctgtctggagtccatgaattct

SEQ ID NO: 113577 - DNA, 25 bp, mus musculus
agctgtctggagtccatgaattctg

SEQ ID NO: 113578 - DNA, 25 bp, mus musculus
acacgctctctggatttcccactga

SEQ ID NO: 113579 - DNA, 25 bp, mus musculus
cacgctctctggatttcccactgac

SEQ ID NO: 113580 - DNA, 25 bp, mus musculus
acgctctctggatttcccactgacc

SEQ ID NO: 113581 - DNA, 25 bp, mus musculus
ggatttcccactgacccagttcttg

SEQ ID NO: 113582 - DNA, 25 bp, mus musculus
gatttcccactgacccagttcttgc

SEQ ID NO: 113583 - DNA, 25 bp, mus musculus
atttcccactgacccagttcttgcg

SEQ ID NO: 113584 - DNA, 25 bp, mus musculus
catctacgttcacttccaaggatac

SEQ ID NO: 113585 - DNA, 25 bp, mus musculus
atctacgttcacttccaaggatacg

SEQ ID NO: 113586 - DNA, 25 bp, mus musculus
tccttcctgccagaattcctatcca

SEQ ID NO: 113587 - DNA, 25 bp, mus musculus
ctgccagaattcctatccagactgt

SEQ ID NO: 113588 - DNA, 25 bp, mus musculus
cactcccaactgcatcaagaaattc

SEQ ID NO: 113589 - DNA, 25 bp, mus musculus
aaagccatgttgactcttacagcca

SEQ ID NO: 113590 - DNA, 25 bp, mus musculus
atgttgactcttacagccactggag

SEQ ID NO: 113591 - DNA, 25 bp, mus musculus
gctaactgaccttcattgcgtctgt

SEQ ID NO: 113592 - DNA, 25 bp, mus musculus
tgaccttcattgcgtctgtcttccc

SEQ ID NO: 113593 - DNA, 25 bp, mus musculus
ggaccccgcaggacaaacagggatg

SEQ ID NO: 113594 - DNA, 25 bp, mus musculus
ttctttagatgtccagttggtatac

SEQ ID NO: 113595 - DNA, 25 bp, mus musculus
ggtataccatgcattctgttaggtg

SEQ ID NO: 113596 - DNA, 25 bp, mus musculus
ccatgcattctgttaggtgattttg

SEQ ID NO: 113597 - DNA, 25 bp, mus musculus
tgtacagttcctctgacctattaaa

SEQ ID NO: 113598 - DNA, 25 bp, mus musculus
gaattcctatccagactgtgttgca

SEQ ID NO: 113599 - DNA, 25 bp, mus musculus
tccgccttctctcctgtggatactg

SEQ ID NO: 113600 - DNA, 25 bp, mus musculus
ttctctcctgtggatactgaagcat

SEQ ID NO: 113601 - DNA, 25 bp, mus musculus
ctgacaaaaacttgcctttcctcat

SEQ ID NO: 113602 - DNA, 25 bp, mus musculus
tgcctttcctcatcagaattctgtg

SEQ ID NO: 113603 - DNA, 25 bp, mus musculus
tcagaattctgtgccagttttgtac

SEQ ID NO: 113604 - DNA, 25 bp, mus musculus
ttctgtgccagttttgtaccagagc

SEQ ID NO: 113605 - DNA, 25 bp, mus musculus
tttgtaccagagcactcccaactgc

SEQ ID NO: 113606 - DNA, 25 bp, mus musculus
aggctctcgcaagcacgggtgacca

SEQ ID NO: 113607 - DNA, 25 bp, mus musculus
ggctctcgcaagcacgggtgaccag

SEQ ID NO: 113608 - DNA, 25 bp, mus musculus
gtgaccagcctctcctgagcacgct

SEQ ID NO: 113609 - DNA, 25 bp, mus musculus
ttgccgtcggagtcaccgcagttcc

SEQ ID NO: 113610 - DNA, 25 bp, mus musculus
tgccgtcggagtcaccgcagttcct

SEQ ID NO: 113611 - DNA, 25 bp, mus musculus
cgtcggagtcaccgcagttcctgcc

SEQ ID NO: 113612 - DNA, 25 bp, mus musculus
gcagttcctgccgccagcctgagtg

SEQ ID NO: 113613 - DNA, 25 bp, mus musculus
tgccgccagcctgagtgcggtccca

SEQ ID NO: 113614 - DNA, 25 bp, mus musculus
cagcctgagtgcggtcccacacgct

SEQ ID NO: 113615 - DNA, 25 bp, mus musculus
cacacgctgccagccagtctttgcg

SEQ ID NO: 113616 - DNA, 25 bp, mus musculus
acacgctgccagccagtctttgcgg

SEQ ID NO: 113617 - DNA, 25 bp, mus musculus
acgctgccagccagtctttgcggcc

SEQ ID NO: 113618 - DNA, 25 bp, mus musculus
gctctcgcaagcacgggtgaccagc

SEQ ID NO: 113619 - DNA, 25 bp, mus musculus
ctctcgcaagcacgggtgaccagcc

SEQ ID NO: 113620 - DNA, 25 bp, mus musculus
tctcgcaagcacgggtgaccagcct

SEQ ID NO: 113621 - DNA, 25 bp, mus musculus
ctcgcaagcacgggtgaccagcctc

SEQ ID NO: 113622 - DNA, 25 bp, mus musculus
tcgcaagcacgggtgaccagcctct

SEQ ID NO: 113623 - DNA, 25 bp, mus musculus
cgcaagcacgggtgaccagcctctc

SEQ ID NO: 113624 - DNA, 25 bp, mus musculus
caagcacgggtgaccagcctctcct

SEQ ID NO: 113625 - DNA, 25 bp, mus musculus
gggtgaccagcctctcctgagcacg

SEQ ID NO: 113626 - DNA, 25 bp, mus musculus
agctccctgaagaacaaactgaggc

SEQ ID NO: 113627 - DNA, 25 bp, mus musculus
ctccctgaagaacaaactgaggcgt

SEQ ID NO: 113628 - DNA, 25 bp, mus musculus
gcactggcgactgctcagacgagga

SEQ ID NO: 113629 - DNA, 25 bp, mus musculus
actggcgactgctcagacgaggagg

SEQ ID NO: 113630 - DNA, 25 bp, mus musculus
ctgctcagacgaggaggtcgacggt

SEQ ID NO: 113631 - DNA, 25 bp, mus musculus
aataggagcttctcctgcagcccag

SEQ ID NO: 113632 - DNA, 25 bp, mus musculus
tctcctgcagcccaggcggatggac

SEQ ID NO: 113633 - DNA, 25 bp, mus musculus
ctgcagcccaggcggatggacaaac

SEQ ID NO: 113634 - DNA, 25 bp, mus musculus
gcagcccaggcggatggacaaacgg

SEQ ID NO: 113635 - DNA, 25 bp, mus musculus
agcccaggcggatggacaaacggct

SEQ ID NO: 113636 - DNA, 25 bp, mus musculus
cctgccttgagactgctctgaccat

SEQ ID NO: 113637 - DNA, 25 bp, mus musculus
ccttgagactgctctgaccatgtcc

SEQ ID NO: 113638 - DNA, 25 bp, mus musculus
cgtgaggacctgccatttgtcgtga

SEQ ID NO: 113639 - DNA, 25 bp, mus musculus
aggacctgccatttgtcgtgactcg

SEQ ID NO: 113640 - DNA, 25 bp, mus musculus
gacctgccatttgtcgtgactcgcc

SEQ ID NO: 113641 - DNA, 25 bp, mus musculus
atttgtcgtgactcgccgaattgtt

SEQ ID NO: 113642 - DNA, 25 bp, mus musculus
ttgtcgtgactcgccgaattgttcg

SEQ ID NO: 113643 - DNA, 25 bp, mus musculus
gtcgtgactcgccgaattgttcgga

SEQ ID NO: 113644 - DNA, 25 bp, mus musculus
tcgccgaattgttcggaaaggcact

SEQ ID NO: 113645 - DNA, 25 bp, mus musculus
aggcactggcgactgctcagacgag

SEQ ID NO: 113646 - DNA, 25 bp, mus musculus
ccgaatgtcgcagaaccttagataa

SEQ ID NO: 113647 - DNA, 25 bp, mus musculus
aatttcaggacatggtccagaagga

SEQ ID NO: 113648 - DNA, 25 bp, mus musculus
cttctgttattctctgcagttgctg

SEQ ID NO: 113649 - DNA, 25 bp, mus musculus
ctgttattctctgcagttgctgaga

SEQ ID NO: 113650 - DNA, 25 bp, mus musculus
gagatgaaccattttctctgtctac

SEQ ID NO: 113651 - DNA, 25 bp, mus musculus
aaccattttctctgtctactgcaat

SEQ ID NO: 113652 - DNA, 25 bp, mus musculus
ctctgtctactgcaatttttacatt

SEQ ID NO: 113653 - DNA, 25 bp, mus musculus
cattcaaatgtccatgaaatttgta

SEQ ID NO: 113654 - DNA, 25 bp, mus musculus
gaatctgcagtgtttgtgtttatat

SEQ ID NO: 113655 - DNA, 25 bp, mus musculus
tgaaacaaatactcgcagttaattg

SEQ ID NO: 113656 - DNA, 25 bp, mus musculus
atggacagttcttttcctctctata

SEQ ID NO: 113657 - DNA, 25 bp, mus musculus
tcttttcctctctatatggaaatgt

SEQ ID NO: 113658 - DNA, 25 bp, mus musculus
ttcaggacatggtccagaaggacct

SEQ ID NO: 113659 - DNA, 25 bp, mus musculus
tacctcagttccagccatgaagaga

SEQ ID NO: 113660 - DNA, 25 bp, mus musculus
gacattggcaactcctggtgtgttc

SEQ ID NO: 113661 - DNA, 25 bp, mus musculus
tgtgttctctttgccagcaaatggt

SEQ ID NO: 113662 - DNA, 25 bp, mus musculus
gttctctttgccagcaaatggtagt

SEQ ID NO: 113663 - DNA, 25 bp, mus musculus
ctctttgccagcaaatggtagttga

SEQ ID NO: 113664 - DNA, 25 bp, mus musculus
ttccagggactgcttctgttattct

SEQ ID NO: 113665 - DNA, 25 bp, mus musculus
ggactgcttctgttattctctgcag

SEQ ID NO: 113666 - DNA, 25 bp, mus musculus
atcggcgacgaccagtgtgagcccg

SEQ ID NO: 113667 - DNA, 25 bp, mus musculus
cggcgacgaccagtgtgagcccgga

SEQ ID NO: 113668 - DNA, 25 bp, mus musculus
aagcgctagacctgtgaggtgtgcg

SEQ ID NO: 113669 - DNA, 25 bp, mus musculus
aagacatggctcccaacgtgttggc

SEQ ID NO: 113670 - DNA, 25 bp, mus musculus
gacatggctcccaacgtgttggctt

SEQ ID NO: 113671 - DNA, 25 bp, mus musculus
tggctcccaacgtgttggcttccga

SEQ ID NO: 113672 - DNA, 25 bp, mus musculus
tccgaaccggagattccgaaggcat

SEQ ID NO: 113673 - DNA, 25 bp, mus musculus
agattccgaaggcatccgggccgtg

SEQ ID NO: 113674 - DNA, 25 bp, mus musculus
agccatggtagcttctggctcagag

SEQ ID NO: 113675 - DNA, 25 bp, mus musculus
tagcttctggctcagagctaggaaa

SEQ ID NO: 113676 - DNA, 25 bp, mus musculus
gcttctggctcagagctaggaaaaa

SEQ ID NO: 113677 - DNA, 25 bp, mus musculus
ttctggctcagagctaggaaaaaag

SEQ ID NO: 113678 - DNA, 25 bp, mus musculus
gacgaccagtgtgagcccggagtag

SEQ ID NO: 113679 - DNA, 25 bp, mus musculus
cgaccagtgtgagcccggagtagga

SEQ ID NO: 113680 - DNA, 25 bp, mus musculus
accagtgtgagcccggagtaggatg

SEQ ID NO: 113681 - DNA, 25 bp, mus musculus
cagtgtgagcccggagtaggatgta

SEQ ID NO: 113682 - DNA, 25 bp, mus musculus
taggatgtacgctggcctggaagcg

SEQ ID NO: 113683 - DNA, 25 bp, mus musculus
ggatgtacgctggcctggaagcgct

SEQ ID NO: 113684 - DNA, 25 bp, mus musculus
gtacgctggcctggaagcgctagac

SEQ ID NO: 113685 - DNA, 25 bp, mus musculus
acgctggcctggaagcgctagacct

SEQ ID NO: 113686 - DNA, 25 bp, mus musculus
gtctgtcccatcctgcagtgtttgg

SEQ ID NO: 113687 - DNA, 25 bp, mus musculus
tgtcccatcctgcagtgtttgggcc

SEQ ID NO: 113688 - DNA, 25 bp, mus musculus
cctggcctgactggaagcagaaaaa

SEQ ID NO: 113689 - DNA, 25 bp, mus musculus
gaaaggccctaggcaagcctgccct

SEQ ID NO: 113690 - DNA, 25 bp, mus musculus
aggccctaggcaagcctgccctgtt

SEQ ID NO: 113691 - DNA, 25 bp, mus musculus
attggtgctccacgtctccagacac

SEQ ID NO: 113692 - DNA, 25 bp, mus musculus
caccatgcatctcactctgggtgta

SEQ ID NO: 113693 - DNA, 25 bp, mus musculus
catgcatctcactctgggtgtactc

SEQ ID NO: 113694 - DNA, 25 bp, mus musculus
cactctgggtgtactcgctcacatt

SEQ ID NO: 113695 - DNA, 25 bp, mus musculus
aactgtcatttctataactctgaag

SEQ ID NO: 113696 - DNA, 25 bp, mus musculus
catttctataactctgaagacccat

SEQ ID NO: 113697 - DNA, 25 bp, mus musculus
aactctgaagacccatgatagtaag

SEQ ID NO: 113698 - DNA, 25 bp, mus musculus
cccatcctgcagtgtttgggcctgg

SEQ ID NO: 113699 - DNA, 25 bp, mus musculus
ggcctggctctttgactcaaagcta

SEQ ID NO: 113700 - DNA, 25 bp, mus musculus
gctctttgactcaaagctagctagg

SEQ ID NO: 113701 - DNA, 25 bp, mus musculus
tgactcaaagctagctaggtggcac

SEQ ID NO: 113702 - DNA, 25 bp, mus musculus
agctaggtggcactccgtgtcgctc

SEQ ID NO: 113703 - DNA, 25 bp, mus musculus
cgtgtcgctcctgcacattctggaa

SEQ ID NO: 113704 - DNA, 25 bp, mus musculus
gtcgctcctgcacattctggaaggg

SEQ ID NO: 113705 - DNA, 25 bp, mus musculus
ccccctggcctgactggaagcagaa

SEQ ID NO: 113706 - DNA, 25 bp, mus musculus
gtcttgctagtgtcttcaaaaaagt

SEQ ID NO: 113707 - DNA, 25 bp, mus musculus
tcaaaaaagttcaccatgggcagaa

SEQ ID NO: 113708 - DNA, 25 bp, mus musculus
caggccccgtgcgacagcatcctgt

SEQ ID NO: 113709 - DNA, 25 bp, mus musculus
tccctacaaatctccattttcatgc

SEQ ID NO: 113710 - DNA, 25 bp, mus musculus
ctacaaatctccattttcatgcttt

SEQ ID NO: 113711 - DNA, 25 bp, mus musculus
caaatctccattttcatgctttcca

SEQ ID NO: 113712 - DNA, 25 bp, mus musculus
tccattttcatgctttccagttcac

SEQ ID NO: 113713 - DNA, 25 bp, mus musculus
attttcatgctttccagttcactct

SEQ ID NO: 113714 - DNA, 25 bp, mus musculus
ttcatgctttccagttcactctcta

SEQ ID NO: 113715 - DNA, 25 bp, mus musculus
acactggcagccctccaattggtag

SEQ ID NO: 113716 - DNA, 25 bp, mus musculus
gccctccaattggtagtgtctgtca

SEQ ID NO: 113717 - DNA, 25 bp, mus musculus
gtgtctgtcacttaaaggttaacag

SEQ ID NO: 113718 - DNA, 25 bp, mus musculus
aagttcaccatgggcagaaagataa

SEQ ID NO: 113719 - DNA, 25 bp, mus musculus
ttcaccatgggcagaaagataaagg

SEQ ID NO: 113720 - DNA, 25 bp, mus musculus
aaggcacacatgtttcagcaagtgt

SEQ ID NO: 113721 - DNA, 25 bp, mus musculus
gcacacatgtttcagcaagtgtcct

SEQ ID NO: 113722 - DNA, 25 bp, mus musculus
caagtgtccttgacagcagccattg

SEQ ID NO: 113723 - DNA, 25 bp, mus musculus
tccttgacagcagccattgctcttc

SEQ ID NO: 113724 - DNA, 25 bp, mus musculus
acagcagccattgctcttctcagtg

SEQ ID NO: 113725 - DNA, 25 bp, mus musculus
tgcaagctctggtgataccaggccc

SEQ ID NO: 113726 - DNA, 25 bp, mus musculus
atatagacatctcgaaggatatcta

SEQ ID NO: 113727 - DNA, 25 bp, mus musculus
tcctgtcacagggtaacagcatgta

SEQ ID NO: 113728 - DNA, 25 bp, mus musculus
agcttggccctctatcagtacacgc

SEQ ID NO: 113729 - DNA, 25 bp, mus musculus
cttggccctctatcagtacacgcaa

SEQ ID NO: 113730 - DNA, 25 bp, mus musculus
ttggccctctatcagtacacgcaaa

SEQ ID NO: 113731 - DNA, 25 bp, mus musculus
ggccctctatcagtacacgcaaatg

SEQ ID NO: 113732 - DNA, 25 bp, mus musculus
cctctatcagtacacgcaaatggtt

SEQ ID NO: 113733 - DNA, 25 bp, mus musculus
ctctatcagtacacgcaaatggttc

SEQ ID NO: 113734 - DNA, 25 bp, mus musculus
ctatcagtacacgcaaatggttcta

SEQ ID NO: 113735 - DNA, 25 bp, mus musculus
tatcagtacacgcaaatggttctaa

SEQ ID NO: 113736 - DNA, 25 bp, mus musculus
tcagtacacgcaaatggttctaagt

SEQ ID NO: 113737 - DNA, 25 bp, mus musculus
tacacgcaaatggttctaagtccct

SEQ ID NO: 113738 - DNA, 25 bp, mus musculus
cctgtcacagggtaacagcatgtac

SEQ ID NO: 113739 - DNA, 25 bp, mus musculus
gtaacagcatgtacgcacgcattgc

SEQ ID NO: 113740 - DNA, 25 bp, mus musculus
gctccatccatggcttcgctgtcta

SEQ ID NO: 113741 - DNA, 25 bp, mus musculus
tccatggcttcgctgtctacctacc

SEQ ID NO: 113742 - DNA, 25 bp, mus musculus
acgatgaagcttggccctctatcag

SEQ ID NO: 113743 - DNA, 25 bp, mus musculus
cgatgaagcttggccctctatcagt

SEQ ID NO: 113744 - DNA, 25 bp, mus musculus
tgaagcttggccctctatcagtaca

SEQ ID NO: 113745 - DNA, 25 bp, mus musculus
aagcttggccctctatcagtacacg

SEQ ID NO: 113746 - DNA, 25 bp, mus musculus
ctccctttcagactgtctgtacgca

SEQ ID NO: 113747 - DNA, 25 bp, mus musculus
cctttcagactgtctgtacgcacaa

SEQ ID NO: 113748 - DNA, 25 bp, mus musculus
aatctgcagtactgacatcggtttc

SEQ ID NO: 113749 - DNA, 25 bp, mus musculus
ctgcagtactgacatcggtttcggc

SEQ ID NO: 113750 - DNA, 25 bp, mus musculus
tgacatcggtttcggcgtctcttgt

SEQ ID NO: 113751 - DNA, 25 bp, mus musculus
catcggtttcggcgtctcttgtcca

SEQ ID NO: 113752 - DNA, 25 bp, mus musculus
cgtctcttgtccactgggcagtttt

SEQ ID NO: 113753 - DNA, 25 bp, mus musculus
ctcttgaagaagcccttgcagccct

SEQ ID NO: 113754 - DNA, 25 bp, mus musculus
tcgcaggtgcggactccgtagtgct

SEQ ID NO: 113755 - DNA, 25 bp, mus musculus
caggtgcggactccgtagtgctggc

SEQ ID NO: 113756 - DNA, 25 bp, mus musculus
actccgtagtgctggcaggcagcgt

SEQ ID NO: 113757 - DNA, 25 bp, mus musculus
tagtgctggcaggcagcgttgtcgc

SEQ ID NO: 113758 - DNA, 25 bp, mus musculus
ttcagactgtctgtacgcacaactt

SEQ ID NO: 113759 - DNA, 25 bp, mus musculus
ctgtctgtacgcacaacttccttaa

SEQ ID NO: 113760 - DNA, 25 bp, mus musculus
tctgtacgcacaacttccttaacca

SEQ ID NO: 113761 - DNA, 25 bp, mus musculus
accatcccgacactgagacacttct

SEQ ID NO: 113762 - DNA, 25 bp, mus musculus
atcccgacactgagacacttctgaa

SEQ ID NO: 113763 - DNA, 25 bp, mus musculus
ccgacactgagacacttctgaaatc

SEQ ID NO: 113764 - DNA, 25 bp, mus musculus
ctgagacacttctgaaatctgcagt

SEQ ID NO: 113765 - DNA, 25 bp, mus musculus
cacttctgaaatctgcagtactgac

SEQ ID NO: 113766 - DNA, 25 bp, mus musculus
aggactgccagagctcttttacctg

SEQ ID NO: 113767 - DNA, 25 bp, mus musculus
gccagagctcttttacctgcaagag

SEQ ID NO: 113768 - DNA, 25 bp, mus musculus
ttcatgggacctggccactcttgtg

SEQ ID NO: 113769 - DNA, 25 bp, mus musculus
ggacctggccactcttgtgcagcct

SEQ ID NO: 113770 - DNA, 25 bp, mus musculus
tagtgctgctctgggtgatcagctg

SEQ ID NO: 113771 - DNA, 25 bp, mus musculus
tgctctgggtgatcagctgagttcc

SEQ ID NO: 113772 - DNA, 25 bp, mus musculus
tcagctgagttcctgttttaccttc

SEQ ID NO: 113773 - DNA, 25 bp, mus musculus
ctgttttaccttcagttgtctggag

SEQ ID NO: 113774 - DNA, 25 bp, mus musculus
taccttcagttgtctggagcgccac

SEQ ID NO: 113775 - DNA, 25 bp, mus musculus
tggggctctgacagcctctttaata

SEQ ID NO: 113776 - DNA, 25 bp, mus musculus
aaaccagacattccacatgtgcctt

SEQ ID NO: 113777 - DNA, 25 bp, mus musculus
gacattccacatgtgccttatgaat

SEQ ID NO: 113778 - DNA, 25 bp, mus musculus
gctcttttacctgcaagagcaattg

SEQ ID NO: 113779 - DNA, 25 bp, mus musculus
acattccacatgtgccttatgaatt

SEQ ID NO: 113780 - DNA, 25 bp, mus musculus
ttacctgcaagagcaattggcacaa

SEQ ID NO: 113781 - DNA, 25 bp, mus musculus
ggaactggtcctctgggcataacga

SEQ ID NO: 113782 - DNA, 25 bp, mus musculus
ggtcctctgggcataacgagtgtcc

SEQ ID NO: 113783 - DNA, 25 bp, mus musculus
ataacgagtgtcctgtgggagcctc

SEQ ID NO: 113784 - DNA, 25 bp, mus musculus
tccccacatctgctgctctgtgtga

SEQ ID NO: 113785 - DNA, 25 bp, mus musculus
catctgctgctctgtgtgaggaaat

SEQ ID NO: 113786 - DNA, 25 bp, mus musculus
ctgggcttcatgggacctggccact

SEQ ID NO: 113787 - DNA, 25 bp, mus musculus
attaacaagtgcccaaacacagcac

SEQ ID NO: 113788 - DNA, 25 bp, mus musculus
aagtgcccaaacacagcaccctgtc

SEQ ID NO: 113789 - DNA, 25 bp, mus musculus
catgcagcagtacttcttgtgccca

SEQ ID NO: 113790 - DNA, 25 bp, mus musculus
gcagtacttcttgtgcccagcctgg

SEQ ID NO: 113791 - DNA, 25 bp, mus musculus
agcctggccccagtgctgtcattat

SEQ ID NO: 113792 - DNA, 25 bp, mus musculus
gccccagtgctgtcattatggctcc

SEQ ID NO: 113793 - DNA, 25 bp, mus musculus
tggctccctggctgagaggtcagtc

SEQ ID NO: 113794 - DNA, 25 bp, mus musculus
tctacccttggtctggttcaactct

SEQ ID NO: 113795 - DNA, 25 bp, mus musculus
ctggttcaactcttcaaagaataag

SEQ ID NO: 113796 - DNA, 25 bp, mus musculus
catccagttcctgatccatgttggg

SEQ ID NO: 113797 - DNA, 25 bp, mus musculus
ctacaatcattttcaataaatctat

SEQ ID NO: 113798 - DNA, 25 bp, mus musculus
tcattttcaataaatctatgacaca

SEQ ID NO: 113799 - DNA, 25 bp, mus musculus
acagcaccctgtcacacgtttgagt

SEQ ID NO: 113800 - DNA, 25 bp, mus musculus
atctatgacacatctgggcctaatg

SEQ ID NO: 113801 - DNA, 25 bp, mus musculus
tttgagtactacttcccgacaccag

SEQ ID NO: 113802 - DNA, 25 bp, mus musculus
gccagcctttgcgagggtctctgga

SEQ ID NO: 113803 - DNA, 25 bp, mus musculus
ctttgcgagggtctctggagtcact

SEQ ID NO: 113804 - DNA, 25 bp, mus musculus
tcaacccagggcaatcccaatgagg

SEQ ID NO: 113805 - DNA, 25 bp, mus musculus
aatcccaatgaggacgtggtgaagt

SEQ ID NO: 113806 - DNA, 25 bp, mus musculus
gcttcctttatgacatctgggactg

SEQ ID NO: 113807 - DNA, 25 bp, mus musculus
gtgccccatgcagcagtacttcttg

SEQ ID NO: 113808 - DNA, 25 bp, mus musculus
tcccattctgggcaaagacaacacc

SEQ ID NO: 113809 - DNA, 25 bp, mus musculus
caaagacaacaccatcgaacacctc

SEQ ID NO: 113810 - DNA, 25 bp, mus musculus
agtccgactgaatatcatctccaac

SEQ ID NO: 113811 - DNA, 25 bp, mus musculus
cgactgaatatcatctccaacctgg

SEQ ID NO: 113812 - DNA, 25 bp, mus musculus
aatatcatctccaacctggattgtg

SEQ ID NO: 113813 - DNA, 25 bp, mus musculus
tatcatctccaacctggattgtgtg

SEQ ID NO: 113814 - DNA, 25 bp, mus musculus
tcatctccaacctggattgtgtgaa

SEQ ID NO: 113815 - DNA, 25 bp, mus musculus
tcctgccatcgtggaactagctgaa

SEQ ID NO: 113816 - DNA, 25 bp, mus musculus
ctgccatcgtggaactagctgaaga

SEQ ID NO: 113817 - DNA, 25 bp, mus musculus
agatgccaagtgagcgagtgcggct

SEQ ID NO: 113818 - DNA, 25 bp, mus musculus
caagtgagcgagtgcggctggccat

SEQ ID NO: 113819 - DNA, 25 bp, mus musculus
agtgcggctggccatcattgaatac

SEQ ID NO: 113820 - DNA, 25 bp, mus musculus
gacaacaccatcgaacacctcttgc

SEQ ID NO: 113821 - DNA, 25 bp, mus musculus
cttgcccctgttcttggctcagctg

SEQ ID NO: 113822 - DNA, 25 bp, mus musculus
cctgttcttggctcagctgaaggat

SEQ ID NO: 113823 - DNA, 25 bp, mus musculus
ttcttggctcagctgaaggatgagt

SEQ ID NO: 113824 - DNA, 25 bp, mus musculus
cttggctcagctgaaggatgagtgt

SEQ ID NO: 113825 - DNA, 25 bp, mus musculus
agtgtcctgaagtccgactgaatat

SEQ ID NO: 113826 - DNA, 25 bp, mus musculus
tgtcctgaagtccgactgaatatca

SEQ ID NO: 113827 - DNA, 25 bp, mus musculus
tcctgaagtccgactgaatatcatc

SEQ ID NO: 113828 - DNA, 25 bp, mus musculus
gactacctggaccagctgacccaga

SEQ ID NO: 113829 - DNA, 25 bp, mus musculus
tacctggaccagctgacccagatcc

SEQ ID NO: 113830 - DNA, 25 bp, mus musculus
aaggatttcacacagctcttcccac

SEQ ID NO: 113831 - DNA, 25 bp, mus musculus
agtccgcaagctgcagacctgctcg

SEQ ID NO: 113832 - DNA, 25 bp, mus musculus
ccgcaagctgcagacctgctcgaca

SEQ ID NO: 113833 - DNA, 25 bp, mus musculus
caagctgcagacctgctcgacaaga

SEQ ID NO: 113834 - DNA, 25 bp, mus musculus
gcagacctgctcgacaagatgctgg

SEQ ID NO: 113835 - DNA, 25 bp, mus musculus
gacctgctcgacaagatgctggagc

SEQ ID NO: 113836 - DNA, 25 bp, mus musculus
aagcgtctgaccgctgctcaggcac

SEQ ID NO: 113837 - DNA, 25 bp, mus musculus
cgtctgaccgctgctcaggcactgg

SEQ ID NO: 113838 - DNA, 25 bp, mus musculus
ctgaccgctgctcaggcactggctc

SEQ ID NO: 113839 - DNA, 25 bp, mus musculus
ttccgggaccctgaggaggagacag

SEQ ID NO: 113840 - DNA, 25 bp, mus musculus
gaccagctgacccagatcctgaaag

SEQ ID NO: 113841 - DNA, 25 bp, mus musculus
cagctgacccagatcctgaaagtga

SEQ ID NO: 113842 - DNA, 25 bp, mus musculus
ctgacccagatcctgaaagtgactg

SEQ ID NO: 113843 - DNA, 25 bp, mus musculus
atcctgaaagtgactggggtgccag

SEQ ID NO: 113844 - DNA, 25 bp, mus musculus
ccaggtgccgagttcgtgcagaagc

SEQ ID NO: 113845 - DNA, 25 bp, mus musculus
gacaaggcggccaaatcctatattc

SEQ ID NO: 113846 - DNA, 25 bp, mus musculus
aaggcggccaaatcctatattcagt

SEQ ID NO: 113847 - DNA, 25 bp, mus musculus
gccaaatcctatattcagtccctgc

SEQ ID NO: 113848 - DNA, 25 bp, mus musculus
ttcatccttagtattgcatatagtc

SEQ ID NO: 113849 - DNA, 25 bp, mus musculus
atccttagtattgcatatagtcctg

SEQ ID NO: 113850 - DNA, 25 bp, mus musculus
atgcccattcgctccttgacctttt

SEQ ID NO: 113851 - DNA, 25 bp, mus musculus
tcccagctccttgtcacggcttcag

SEQ ID NO: 113852 - DNA, 25 bp, mus musculus
cagctccttgtcacggcttcagatg

SEQ ID NO: 113853 - DNA, 25 bp, mus musculus
gtcacggcttcagatgatggctaca

SEQ ID NO: 113854 - DNA, 25 bp, mus musculus
gatgtacaacatgccaatttggctg

SEQ ID NO: 113855 - DNA, 25 bp, mus musculus
gtacaacatgccaatttggctggca

SEQ ID NO: 113856 - DNA, 25 bp, mus musculus
caacatgccaatttggctggcacac

SEQ ID NO: 113857 - DNA, 25 bp, mus musculus
gccaatttggctggcacactgagtg

SEQ ID NO: 113858 - DNA, 25 bp, mus musculus
aatttggctggcacactgagtggcc

SEQ ID NO: 113859 - DNA, 25 bp, mus musculus
acactgagtggccatgcgtcctggg

SEQ ID NO: 113860 - DNA, 25 bp, mus musculus
gcatatagtcctgatgggaaatacc

SEQ ID NO: 113861 - DNA, 25 bp, mus musculus
gggaaatacctggccagcggaccag

SEQ ID NO: 113862 - DNA, 25 bp, mus musculus
tacctggccagcggaccagtagacg

SEQ ID NO: 113863 - DNA, 25 bp, mus musculus
ctggccagcggaccagtagacggaa

SEQ ID NO: 113864 - DNA, 25 bp, mus musculus
tttgacattgcaactggaaagcttt

SEQ ID NO: 113865 - DNA, 25 bp, mus musculus
cttttgcatacgctggaaggccatg

SEQ ID NO: 113866 - DNA, 25 bp, mus musculus
ttgcatacgctggaaggccatgcga

SEQ ID NO: 113867 - DNA, 25 bp, mus musculus
gaaggccatgcgatgcccattcgct

SEQ ID NO: 113868 - DNA, 25 bp, mus musculus
gcacctaccactgcaagggctatct

SEQ ID NO: 113869 - DNA, 25 bp, mus musculus
accactgcaagggctatcttaggca

SEQ ID NO: 113870 - DNA, 25 bp, mus musculus
attttctgcagaatcctcaatagct

SEQ ID NO: 113871 - DNA, 25 bp, mus musculus
tgcagaatcctcaatagcttctcca

SEQ ID NO: 113872 - DNA, 25 bp, mus musculus
atcctcaatagcttctccactgtca

SEQ ID NO: 113873 - DNA, 25 bp, mus musculus
ttctccactgtcaaaggccactcat

SEQ ID NO: 113874 - DNA, 25 bp, mus musculus
actgtcaaaggccactcatgtgatc

SEQ ID NO: 113875 - DNA, 25 bp, mus musculus
aaaggccactcatgtgatccctaga

SEQ ID NO: 113876 - DNA, 25 bp, mus musculus
cactcatgtgatccctagaaaagtc

SEQ ID NO: 113877 - DNA, 25 bp, mus musculus
ctgttccacaggaattgcataaatg

SEQ ID NO: 113878 - DNA, 25 bp, mus musculus
gcttcattaaaccaactgcagctgg

SEQ ID NO: 113879 - DNA, 25 bp, mus musculus
ttaaaccaactgcagctggttatgt

SEQ ID NO: 113880 - DNA, 25 bp, mus musculus
ttttcccattgttggtggcgattct

SEQ ID NO: 113881 - DNA, 25 bp, mus musculus
cattgttggtggcgattctgtttgc

SEQ ID NO: 113882 - DNA, 25 bp, mus musculus
cgattctgtttgctgtggacacggg

SEQ ID NO: 113883 - DNA, 25 bp, mus musculus
ggttattgctctcaaccgaagaaca

SEQ ID NO: 113884 - DNA, 25 bp, mus musculus
tgctctcaaccgaagaacagttcaa

SEQ ID NO: 113885 - DNA, 25 bp, mus musculus
agttcaaatcagtcttggagattca

SEQ ID NO: 113886 - DNA, 25 bp, mus musculus
aatcagtcttggagattcagaagac

SEQ ID NO: 113887 - DNA, 25 bp, mus musculus
tcctaacctagatacatataggaac

SEQ ID NO: 113888 - DNA, 25 bp, mus musculus
ccactcctaagttaggacatggagc

SEQ ID NO: 113889 - DNA, 25 bp, mus musculus
atggagcccagatactatgatacca

SEQ ID NO: 113890 - DNA, 25 bp, mus musculus
agggcagcctagctctttttgtcac

SEQ ID NO: 113891 - DNA, 25 bp, mus musculus
gcctagctctttttgtcaccatgcc

SEQ ID NO: 113892 - DNA, 25 bp, mus musculus
ctctttttgtcaccatgccccgagc

SEQ ID NO: 113893 - DNA, 25 bp, mus musculus
tgtggccccagaactgcccatcctt

SEQ ID NO: 113894 - DNA, 25 bp, mus musculus
catccttaaaatgatccttgcccag

SEQ ID NO: 113895 - DNA, 25 bp, mus musculus
cctggcatacctgccctagaactgt

SEQ ID NO: 113896 - DNA, 25 bp, mus musculus
atacctgccctagaactgttatgtt

SEQ ID NO: 113897 - DNA, 25 bp, mus musculus
gccctagaactgttatgttgggcat

SEQ ID NO: 113898 - DNA, 25 bp, mus musculus
tgagcctttgttgctttcaaaacga

SEQ ID NO: 113899 - DNA, 25 bp, mus musculus
tttgttgctttcaaaacgagaacag

SEQ ID NO: 113900 - DNA, 25 bp, mus musculus
tactatgataccaaattcaggggtg

SEQ ID NO: 113901 - DNA, 25 bp, mus musculus
agaggttcccatatcattctttcta

SEQ ID NO: 113902 - DNA, 25 bp, mus musculus
aaattcaggggtgtcacagccattt

SEQ ID NO: 113903 - DNA, 25 bp, mus musculus
gtcacagccattttgttctgccctg

SEQ ID NO: 113904 - DNA, 25 bp, mus musculus
gccattttgttctgccctgcaagtt

SEQ ID NO: 113905 - DNA, 25 bp, mus musculus
tgccctgcaagttttagatccaatc

SEQ ID NO: 113906 - DNA, 25 bp, mus musculus
tttagatccaatctgcctcaacagt

SEQ ID NO: 113907 - DNA, 25 bp, mus musculus
tccaatctgcctcaacagtcaatca

SEQ ID NO: 113908 - DNA, 25 bp, mus musculus
catatttatggccaggcattttatc

SEQ ID NO: 113909 - DNA, 25 bp, mus musculus
caataacttcgcttatatgaacaac

SEQ ID NO: 113910 - DNA, 25 bp, mus musculus
aaccgaagacgacggctgctttgtg

SEQ ID NO: 113911 - DNA, 25 bp, mus musculus
cacattctgtcagtttttcaattgg

SEQ ID NO: 113912 - DNA, 25 bp, mus musculus
gattgttctgcagatgccactcttt

SEQ ID NO: 113913 - DNA, 25 bp, mus musculus
tctgcagatgccactcttttagtta

SEQ ID NO: 113914 - DNA, 25 bp, mus musculus
gatgccactcttttagttatgctgt

SEQ ID NO: 113915 - DNA, 25 bp, mus musculus
actcttttagttatgctgtatctga

SEQ ID NO: 113916 - DNA, 25 bp, mus musculus
atgctgtatctgatcttctaaatat

SEQ ID NO: 113917 - DNA, 25 bp, mus musculus
tatctgatcttctaaatatctccct

SEQ ID NO: 113918 - DNA, 25 bp, mus musculus
taaatatctccctttttgcggatat

SEQ ID NO: 113919 - DNA, 25 bp, mus musculus
tgtgtcacaatttcacatacatctt

SEQ ID NO: 113920 - DNA, 25 bp, mus musculus
acaatttcacatacatcttttctgg

SEQ ID NO: 113921 - DNA, 25 bp, mus musculus
ctttgtggcttctttcaccacagaa

SEQ ID NO: 113922 - DNA, 25 bp, mus musculus
ggcttctttcaccacagaactggtg

SEQ ID NO: 113923 - DNA, 25 bp, mus musculus
gatgctgtttctcaccatcctggcc

SEQ ID NO: 113924 - DNA, 25 bp, mus musculus
gtttctcaccatcctggccttttgc

SEQ ID NO: 113925 - DNA, 25 bp, mus musculus
caccatcctggccttttgcagtgct

SEQ ID NO: 113926 - DNA, 25 bp, mus musculus
ggtcccagatgatcgtctttatgaa

SEQ ID NO: 113927 - DNA, 25 bp, mus musculus
ggaaacatcttctccagttgattca

SEQ ID NO: 113928 - DNA, 25 bp, mus musculus
atcttctccagttgattcataagaa

SEQ ID NO: 113929 - DNA, 25 bp, mus musculus
cagctgtgttggcgacatggctgac

SEQ ID NO: 113930 - DNA, 25 bp, mus musculus
ctgtgttggcgacatggctgacaac

SEQ ID NO: 113931 - DNA, 25 bp, mus musculus
gtttaacatcatggtggttgggcag

SEQ ID NO: 113932 - DNA, 25 bp, mus musculus
taacatcatggtggttgggcagagc

SEQ ID NO: 113933 - DNA, 25 bp, mus musculus
cactttaatcaataccctcttcaag

SEQ ID NO: 113934 - DNA, 25 bp, mus musculus
taccctcttcaagtccaaaatcagc

SEQ ID NO: 113935 - DNA, 25 bp, mus musculus
cctcttcaagtccaaaatcagccgg

SEQ ID NO: 113936 - DNA, 25 bp, mus musculus
cttcaagtccaaaatcagccggaag

SEQ ID NO: 113937 - DNA, 25 bp, mus musculus
caagtccaaaatcagccggaagtcg

SEQ ID NO: 113938 - DNA, 25 bp, mus musculus
aatcagccggaagtcggtgcagccc

SEQ ID NO: 113939 - DNA, 25 bp, mus musculus
cagccggaagtcggtgcagcccacc

SEQ ID NO: 113940 - DNA, 25 bp, mus musculus
ggaacgcatccccaagacgatcgaa

SEQ ID NO: 113941 - DNA, 25 bp, mus musculus
tgttggcgacatggctgacaaccct

SEQ ID NO: 113942 - DNA, 25 bp, mus musculus
catggctgacaaccctagagatgcc

SEQ ID NO: 113943 - DNA, 25 bp, mus musculus
ggctgacaaccctagagatgccatg

SEQ ID NO: 113944 - DNA, 25 bp, mus musculus
tgacaaccctagagatgccatgctc

SEQ ID NO: 113945 - DNA, 25 bp, mus musculus
caaccctagagatgccatgctcaag

SEQ ID NO: 113946 - DNA, 25 bp, mus musculus
catggagttcggctatgtggggatc

SEQ ID NO: 113947 - DNA, 25 bp, mus musculus
cgactccatcctggagcagatgcgc

SEQ ID NO: 113948 - DNA, 25 bp, mus musculus
catcctggagcagatgcgcaggaag

SEQ ID NO: 113949 - DNA, 25 bp, mus musculus
ggatgatctcagccgtgatcttgtt

SEQ ID NO: 113950 - DNA, 25 bp, mus musculus
gatctcagccgtgatcttgttcttg

SEQ ID NO: 113951 - DNA, 25 bp, mus musculus
ctgtcgactcaagatccaggtccga

SEQ ID NO: 113952 - DNA, 25 bp, mus musculus
gtcgactcaagatccaggtccgaaa

SEQ ID NO: 113953 - DNA, 25 bp, mus musculus
cgactcaagatccaggtccgaaagg

SEQ ID NO: 113954 - DNA, 25 bp, mus musculus
actcaagatccaggtccgaaaggca

SEQ ID NO: 113955 - DNA, 25 bp, mus musculus
aagatccaggtccgaaaggcagcta

SEQ ID NO: 113956 - DNA, 25 bp, mus musculus
aagcagatgctgtctacacgggcct

SEQ ID NO: 113957 - DNA, 25 bp, mus musculus
cacgggcctgaacacccggagccag

SEQ ID NO: 113958 - DNA, 25 bp, mus musculus
ggcctgaacacccggagccaggaga

SEQ ID NO: 113959 - DNA, 25 bp, mus musculus
tgaacacccggagccaggagacata

SEQ ID NO: 113960 - DNA, 25 bp, mus musculus
aacacccggagccaggagacatatg

SEQ ID NO: 113961 - DNA, 25 bp, mus musculus
tctcagccgtgatcttgttcttgct

SEQ ID NO: 113962 - DNA, 25 bp, mus musculus
agccgtgatcttgttcttgctcctt

SEQ ID NO: 113963 - DNA, 25 bp, mus musculus
tcttgctccttttggtggaacaagc

SEQ ID NO: 113964 - DNA, 25 bp, mus musculus
ctatatcctggatgctgtcctgttt

SEQ ID NO: 113965 - DNA, 25 bp, mus musculus
cctggatgctgtcctgtttttgtat

SEQ ID NO: 113966 - DNA, 25 bp, mus musculus
tggatgctgtcctgtttttgtatgg

SEQ ID NO: 113967 - DNA, 25 bp, mus musculus
tatggtattgtccttaccctactct

SEQ ID NO: 113968 - DNA, 25 bp, mus musculus
tctactgtcgactcaagatccaggt

SEQ ID NO: 113969 - DNA, 25 bp, mus musculus
aactctaaacagctccagcaaggcg

SEQ ID NO: 113970 - DNA, 25 bp, mus musculus
ctccagcaaggcgagcctggctctg

SEQ ID NO: 113971 - DNA, 25 bp, mus musculus
aatgcccaatcaaaatacaccatca

SEQ ID NO: 113972 - DNA, 25 bp, mus musculus
caatcaaaatacaccatcacatcat

SEQ ID NO: 113973 - DNA, 25 bp, mus musculus
accatcacatcatagcccagtctaa

SEQ ID NO: 113974 - DNA, 25 bp, mus musculus
acatcatagcccagtctaacagacc

SEQ ID NO: 113975 - DNA, 25 bp, mus musculus
tagcccagtctaacagaccgccctt

SEQ ID NO: 113976 - DNA, 25 bp, mus musculus
aaattacacctgcgaggtcacttgg

SEQ ID NO: 113977 - DNA, 25 bp, mus musculus
cacctgcgaggtcacttgggctgct

SEQ ID NO: 113978 - DNA, 25 bp, mus musculus
cacttgggctgctgtttttctgcct

SEQ ID NO: 113979 - DNA, 25 bp, mus musculus
ggctgctgtttttctgcctgagtca

SEQ ID NO: 113980 - DNA, 25 bp, mus musculus
tctgcctgagtcagagggcagccac

SEQ ID NO: 113981 - DNA, 25 bp, mus musculus
caaggcgagcctggctctgtctggt

SEQ ID NO: 113982 - DNA, 25 bp, mus musculus
gagcctggctctgtctggtaggcct

SEQ ID NO: 113983 - DNA, 25 bp, mus musculus
ctcctcctgaggctgactacaaggt

SEQ ID NO: 113984 - DNA, 25 bp, mus musculus
ctgactacaaggtccagctatccaa

SEQ ID NO: 113985 - DNA, 25 bp, mus musculus
acaaggtccagctatccaagtactg

SEQ ID NO: 113986 - DNA, 25 bp, mus musculus
tatccaagtactgaagtctaacatc

SEQ ID NO: 113987 - DNA, 25 bp, mus musculus
cacctaagtagcaatgcccaatcaa

SEQ ID NO: 113988 - DNA, 25 bp, mus musculus
agtagcaatgcccaatcaaaataca

SEQ ID NO: 113989 - DNA, 25 bp, mus musculus
atgtcttcagatgcacagtggttga

SEQ ID NO: 113990 - DNA, 25 bp, mus musculus
gtcttcagatgcacagtggttgacg

SEQ ID NO: 113991 - DNA, 25 bp, mus musculus
atgccatctacaaagagttctcctt

SEQ ID NO: 113992 - DNA, 25 bp, mus musculus
gttctccttcaaaaatttcaatcag

SEQ ID NO: 113993 - DNA, 25 bp, mus musculus
tccttcaaaaatttcaatcaggcgt

SEQ ID NO: 113994 - DNA, 25 bp, mus musculus
atttcaatcaggcgtttggctttat

SEQ ID NO: 113995 - DNA, 25 bp, mus musculus
ttcaatcaggcgtttggctttatgt

SEQ ID NO: 113996 - DNA, 25 bp, mus musculus
atcaggcgtttggctttatgtccag

SEQ ID NO: 113997 - DNA, 25 bp, mus musculus
tggctttatgtccagggttgccctg

SEQ ID NO: 113998 - DNA, 25 bp, mus musculus
gctttatgtccagggttgccctgca

SEQ ID NO: 113999 - DNA, 25 bp, mus musculus
tttatgtccagggttgccctgcaag

SEQ ID NO: 114000 - DNA, 25 bp, mus musculus
gttgccctgcaagcagagaagatga

SEQ ID NO: 114001 - DNA, 25 bp, mus musculus
cttcagatgcacagtggttgacggc

SEQ ID NO: 114002 - DNA, 25 bp, mus musculus
ttcaacgtctacaacaaagtccaga

SEQ ID NO: 114003 - DNA, 25 bp, mus musculus
atgcacagtggttgacggcagagga

SEQ ID NO: 114004 - DNA, 25 bp, mus musculus
caacttattcctggcttgaaagcag

SEQ ID NO: 114005 - DNA, 25 bp, mus musculus
acttattcctggcttgaaagcagca

SEQ ID NO: 114006 - DNA, 25 bp, mus musculus
ttattcctggcttgaaagcagcagg

SEQ ID NO: 114007 - DNA, 25 bp, mus musculus
aaagcagcagggtggtcggaactga

SEQ ID NO: 114008 - DNA, 25 bp, mus musculus
agagatgccatctacaaagagttct

SEQ ID NO: 114009 - DNA, 25 bp, mus musculus
agatgccatctacaaagagttctcc

SEQ ID NO: 114010 - DNA, 25 bp, mus musculus
tgcttgaacggaacccggtgctcga

SEQ ID NO: 114011 - DNA, 25 bp, mus musculus
ccgcttcgagcctgagccctttgca

SEQ ID NO: 114012 - DNA, 25 bp, mus musculus
gcctgagccctttgcaacttcgtcg

SEQ ID NO: 114013 - DNA, 25 bp, mus musculus
cctgagccctttgcaacttcgtcgt

SEQ ID NO: 114014 - DNA, 25 bp, mus musculus
ctgagccctttgcaacttcgtcgtt

SEQ ID NO: 114015 - DNA, 25 bp, mus musculus
tgagccctttgcaacttcgtcgttc

SEQ ID NO: 114016 - DNA, 25 bp, mus musculus
atgtcttgttattttgaccgagatg

SEQ ID NO: 114017 - DNA, 25 bp, mus musculus
tgtcttgttattttgaccgagatga

SEQ ID NO: 114018 - DNA, 25 bp, mus musculus
gtcttgttattttgaccgagatgat

SEQ ID NO: 114019 - DNA, 25 bp, mus musculus
tcttgttattttgaccgagatgatg

SEQ ID NO: 114020 - DNA, 25 bp, mus musculus
ttgttattttgaccgagatgatgtg

SEQ ID NO: 114021 - DNA, 25 bp, mus musculus
tgttattttgaccgagatgatgtgg

SEQ ID NO: 114022 - DNA, 25 bp, mus musculus
cgcttcgagcctgagccctttgcaa

SEQ ID NO: 114023 - DNA, 25 bp, mus musculus
gcttcgagcctgagccctttgcaac

SEQ ID NO: 114024 - DNA, 25 bp, mus musculus
cttcgagcctgagccctttgcaact

SEQ ID NO: 114025 - DNA, 25 bp, mus musculus
ttcgagcctgagccctttgcaactt

SEQ ID NO: 114026 - DNA, 25 bp, mus musculus
tcgagcctgagccctttgcaacttc

SEQ ID NO: 114027 - DNA, 25 bp, mus musculus
cgagcctgagccctttgcaacttcg

SEQ ID NO: 114028 - DNA, 25 bp, mus musculus
gagcctgagccctttgcaacttcgt

SEQ ID NO: 114029 - DNA, 25 bp, mus musculus
agcctgagccctttgcaacttcgtc

SEQ ID NO: 114030 - DNA, 25 bp, mus musculus
cgccttggaggtcccgtggatctgt

SEQ ID NO: 114031 - DNA, 25 bp, mus musculus
cttggaggtcccgtggatctgtgta

SEQ ID NO: 114032 - DNA, 25 bp, mus musculus
gatctgtgtacttgcttcaacagtg

SEQ ID NO: 114033 - DNA, 25 bp, mus musculus
atctgtgtacttgcttcaacagtgt

SEQ ID NO: 114034 - DNA, 25 bp, mus musculus
tctgtgtacttgcttcaacagtgtt

SEQ ID NO: 114035 - DNA, 25 bp, mus musculus
tgtgtacttgcttcaacagtgtttg

SEQ ID NO: 114036 - DNA, 25 bp, mus musculus
gtgtacttgcttcaacagtgtttga

SEQ ID NO: 114037 - DNA, 25 bp, mus musculus
tgtacttgcttcaacagtgtttgaa

SEQ ID NO: 114038 - DNA, 25 bp, mus musculus
gcgcggagcgtctcctcgagtttca

SEQ ID NO: 114039 - DNA, 25 bp, mus musculus
cgcggagcgtctcctcgagtttcag

SEQ ID NO: 114040 - DNA, 25 bp, mus musculus
gcggagcgtctcctcgagtttcaga

SEQ ID NO: 114041 - DNA, 25 bp, mus musculus
ggagcgtctcctcgagtttcagaac

SEQ ID NO: 114042 - DNA, 25 bp, mus musculus
ttggaggtcccgtggatctgtgtac

SEQ ID NO: 114043 - DNA, 25 bp, mus musculus
ggaggtcccgtggatctgtgtactt

SEQ ID NO: 114044 - DNA, 25 bp, mus musculus
gaggtcccgtggatctgtgtacttg

SEQ ID NO: 114045 - DNA, 25 bp, mus musculus
aggtcccgtggatctgtgtacttgc

SEQ ID NO: 114046 - DNA, 25 bp, mus musculus
gtcccgtggatctgtgtacttgctt

SEQ ID NO: 114047 - DNA, 25 bp, mus musculus
cgtggatctgtgtacttgcttcaac

SEQ ID NO: 114048 - DNA, 25 bp, mus musculus
gtggatctgtgtacttgcttcaaca

SEQ ID NO: 114049 - DNA, 25 bp, mus musculus
tggatctgtgtacttgcttcaacag

SEQ ID NO: 114050 - DNA, 25 bp, mus musculus
atcctaatcttgactgagtgcttat

SEQ ID NO: 114051 - DNA, 25 bp, mus musculus
ctaatcttgactgagtgcttatttt

SEQ ID NO: 114052 - DNA, 25 bp, mus musculus
tagtctccaacatatttcatcatat

SEQ ID NO: 114053 - DNA, 25 bp, mus musculus
tctccaacatatttcatcatatcaa

SEQ ID NO: 114054 - DNA, 25 bp, mus musculus
tatttcatcatatcaacctcctttc

SEQ ID NO: 114055 - DNA, 25 bp, mus musculus
cccctcataactaattcttgcctga

SEQ ID NO: 114056 - DNA, 25 bp, mus musculus
actaattcttgcctgaatttgtaat

SEQ ID NO: 114057 - DNA, 25 bp, mus musculus
tcttgcctgaatttgtaatgaaatg

SEQ ID NO: 114058 - DNA, 25 bp, mus musculus
agcagaatctgctcttctatatttg

SEQ ID NO: 114059 - DNA, 25 bp, mus musculus
agaatctgctcttctatatttggat

SEQ ID NO: 114060 - DNA, 25 bp, mus musculus
taatcactttctctaaaactttgct

SEQ ID NO: 114061 - DNA, 25 bp, mus musculus
tcactttctctaaaactttgctctt

SEQ ID NO: 114062 - DNA, 25 bp, mus musculus
gacctgtgtctgatagccttgaatt

SEQ ID NO: 114063 - DNA, 25 bp, mus musculus
tttcctgcatatatgtgtgtataca

SEQ ID NO: 114064 - DNA, 25 bp, mus musculus
tgtgtatacacacacacatatatac

SEQ ID NO: 114065 - DNA, 25 bp, mus musculus
tatgcacatacacatacatgcatgc

SEQ ID NO: 114066 - DNA, 25 bp, mus musculus
gcacatacacatacatgcatgcata

SEQ ID NO: 114067 - DNA, 25 bp, mus musculus
catacatgcatgcatatatagacat

SEQ ID NO: 114068 - DNA, 25 bp, mus musculus
catacatatacacatacatatatgc

SEQ ID NO: 114069 - DNA, 25 bp, mus musculus
tgatagtctccaacatatttcatca

SEQ ID NO: 114070 - DNA, 25 bp, mus musculus
tatggacctcactcttctgtgggtt

SEQ ID NO: 114071 - DNA, 25 bp, mus musculus
tcttctgtgggttcttctgccactg

SEQ ID NO: 114072 - DNA, 25 bp, mus musculus
cagcagtaccaggactacggtgatg

SEQ ID NO: 114073 - DNA, 25 bp, mus musculus
cagtaccaggactacggtgatgatg

SEQ ID NO: 114074 - DNA, 25 bp, mus musculus
taccaggactacggtgatgatggat

SEQ ID NO: 114075 - DNA, 25 bp, mus musculus
aatcttaaccgccaaggcttcagct

SEQ ID NO: 114076 - DNA, 25 bp, mus musculus
aaccgccaaggcttcagctaccagt

SEQ ID NO: 114077 - DNA, 25 bp, mus musculus
caaggcttcagctaccagtgtcccc

SEQ ID NO: 114078 - DNA, 25 bp, mus musculus
ggcttcagctaccagtgtccccacg

SEQ ID NO: 114079 - DNA, 25 bp, mus musculus
ttcagctaccagtgtccccacgtgc

SEQ ID NO: 114080 - DNA, 25 bp, mus musculus
taccagtgtccccacgtgcaagtgg

SEQ ID NO: 114081 - DNA, 25 bp, mus musculus
tggaactatgcctgcatgcctacac

SEQ ID NO: 114082 - DNA, 25 bp, mus musculus
ggttcttctgccactggtgaccaca

SEQ ID NO: 114083 - DNA, 25 bp, mus musculus
tcttctgccactggtgaccacagcc

SEQ ID NO: 114084 - DNA, 25 bp, mus musculus
tctgccactggtgaccacagcctgg

SEQ ID NO: 114085 - DNA, 25 bp, mus musculus
ggtgaccacagcctggggcagtatg

SEQ ID NO: 114086 - DNA, 25 bp, mus musculus
gaccacagcctggggcagtatggtg

SEQ ID NO: 114087 - DNA, 25 bp, mus musculus
gggtacccataccagcagtaccagg

SEQ ID NO: 114088 - DNA, 25 bp, mus musculus
tacccataccagcagtaccaggact

SEQ ID NO: 114089 - DNA, 25 bp, mus musculus
ccataccagcagtaccaggactacg

SEQ ID NO: 114090 - DNA, 25 bp, mus musculus
gaccttcacaaagagctcactgtca

SEQ ID NO: 114091 - DNA, 25 bp, mus musculus
cacaaagagctcactgtcatcaaga

SEQ ID NO: 114092 - DNA, 25 bp, mus musculus
tattagctaaccacagcaaccctgc

SEQ ID NO: 114093 - DNA, 25 bp, mus musculus
acagcaaccctgccatttgataccg

SEQ ID NO: 114094 - DNA, 25 bp, mus musculus
accctgccatttgataccgctgtaa

SEQ ID NO: 114095 - DNA, 25 bp, mus musculus
ccatttgataccgctgtaaagagaa

SEQ ID NO: 114096 - DNA, 25 bp, mus musculus
gcctgcctttaatacctaggaccat

SEQ ID NO: 114097 - DNA, 25 bp, mus musculus
ttggtgatctccaaggttttctact

SEQ ID NO: 114098 - DNA, 25 bp, mus musculus
tctagacacgcctgtgggctgctgt

SEQ ID NO: 114099 - DNA, 25 bp, mus musculus
ctataaactgccttggtagcgcatg

SEQ ID NO: 114100 - DNA, 25 bp, mus musculus
actgccttggtagcgcatgcttgca

SEQ ID NO: 114101 - DNA, 25 bp, mus musculus
ttggtagcgcatgcttgcaggacac

SEQ ID NO: 114102 - DNA, 25 bp, mus musculus
gagctcactgtcatcaagaagatga

SEQ ID NO: 114103 - DNA, 25 bp, mus musculus
atgccacctgtaggactctgtcctc

SEQ ID NO: 114104 - DNA, 25 bp, mus musculus
cctgtaggactctgtcctcagtcac

SEQ ID NO: 114105 - DNA, 25 bp, mus musculus
ctttataccaccttactgcaaccat

SEQ ID NO: 114106 - DNA, 25 bp, mus musculus
accaccttactgcaaccatctttga

SEQ ID NO: 114107 - DNA, 25 bp, mus musculus
ttactgcaaccatctttgaaggtta

SEQ ID NO: 114108 - DNA, 25 bp, mus musculus
tagtccatcccagagccgtattagc

SEQ ID NO: 114109 - DNA, 25 bp, mus musculus
atcccagagccgtattagctaacca

SEQ ID NO: 114110 - DNA, 25 bp, mus musculus
aagtgcccagcaaattagaaacact

SEQ ID NO: 114111 - DNA, 25 bp, mus musculus
gacacaaacgccatgagaaggcctt

SEQ ID NO: 114112 - DNA, 25 bp, mus musculus
ttcacagtgtgatgctcagacccaa

SEQ ID NO: 114113 - DNA, 25 bp, mus musculus
gtgtgatgctcagacccaattctaa

SEQ ID NO: 114114 - DNA, 25 bp, mus musculus
tgctcagacccaattctaactccaa

SEQ ID NO: 114115 - DNA, 25 bp, mus musculus
actccaactccaggggtactgcata

SEQ ID NO: 114116 - DNA, 25 bp, mus musculus
actccaggggtactgcatacacatg

SEQ ID NO: 114117 - DNA, 25 bp, mus musculus
tgttcatttgtttgacagggatcta

SEQ ID NO: 114118 - DNA, 25 bp, mus musculus
atccttatagcaacactgtcatatc

SEQ ID NO: 114119 - DNA, 25 bp, mus musculus
atagcaacactgtcatatcttagca

SEQ ID NO: 114120 - DNA, 25 bp, mus musculus
acactgtcatatcttagcacagaag

SEQ ID NO: 114121 - DNA, 25 bp, mus musculus
gtcagatgacactcttgagagttca

SEQ ID NO: 114122 - DNA, 25 bp, mus musculus
tgagacttatcttctcgttgcttct

SEQ ID NO: 114123 - DNA, 25 bp, mus musculus
tctcgttgcttcttatatagcttga

SEQ ID NO: 114124 - DNA, 25 bp, mus musculus
agattcacaatcagccacagaggat

SEQ ID NO: 114125 - DNA, 25 bp, mus musculus
ctacttagttatctaacatgctaca

SEQ ID NO: 114126 - DNA, 25 bp, mus musculus
agttatctaacatgctacattcatt

SEQ ID NO: 114127 - DNA, 25 bp, mus musculus
attcattcatgaggcctttcctctt

SEQ ID NO: 114128 - DNA, 25 bp, mus musculus
ggcctttcctctttgtcttccactg

SEQ ID NO: 114129 - DNA, 25 bp, mus musculus
tccactgtgctttaagaatgggtat

SEQ ID NO: 114130 - DNA, 25 bp, mus musculus
gtcaaatacttcacctccacttgca

SEQ ID NO: 114131 - DNA, 25 bp, mus musculus
ttcacctccacttgcatattccatg

SEQ ID NO: 114132 - DNA, 25 bp, mus musculus
tacttctctgaagagcttttgtaga

SEQ ID NO: 114133 - DNA, 25 bp, mus musculus
ttctctgaagagcttttgtagactt

SEQ ID NO: 114134 - DNA, 25 bp, mus musculus
tattgcaacctctcggcctgtgagg

SEQ ID NO: 114135 - DNA, 25 bp, mus musculus
gtgtctcgccaatttcacttttgca

SEQ ID NO: 114136 - DNA, 25 bp, mus musculus
tctcgccaatttcacttttgcaaag

SEQ ID NO: 114137 - DNA, 25 bp, mus musculus
tgcaaagttccccttgccgattgtt

SEQ ID NO: 114138 - DNA, 25 bp, mus musculus
cttgccgattgttttcaacagtctg

SEQ ID NO: 114139 - DNA, 25 bp, mus musculus
tttcaacagtctgtagtttccgatg

SEQ ID NO: 114140 - DNA, 25 bp, mus musculus
caacagtctgtagtttccgatgtga

SEQ ID NO: 114141 - DNA, 25 bp, mus musculus
cagtctgtagtttccgatgtgaggc

SEQ ID NO: 114142 - DNA, 25 bp, mus musculus
acctccacttgcatattccatgatt

SEQ ID NO: 114143 - DNA, 25 bp, mus musculus
ttcaatgacttcgaacaacttcact

SEQ ID NO: 114144 - DNA, 25 bp, mus musculus
aatgacttcgaacaacttcactatg

SEQ ID NO: 114145 - DNA, 25 bp, mus musculus
ttcgaacaacttcactatgtttggg

SEQ ID NO: 114146 - DNA, 25 bp, mus musculus
gaacaacttcactatgtttgggtga

SEQ ID NO: 114147 - DNA, 25 bp, mus musculus
caacttcactatgtttgggtgattt

SEQ ID NO: 114148 - DNA, 25 bp, mus musculus
cttcattattcttacttctctgaag

SEQ ID NO: 114149 - DNA, 25 bp, mus musculus
cattattcttacttctctgaagagc

SEQ ID NO: 114150 - DNA, 25 bp, mus musculus
caccgttgcgtccctatttgctctc

SEQ ID NO: 114151 - DNA, 25 bp, mus musculus
ctatttgctctcgctacttaggtct

SEQ ID NO: 114152 - DNA, 25 bp, mus musculus
ctgtgcgcagcactcaccgaactca

SEQ ID NO: 114153 - DNA, 25 bp, mus musculus
tgtgcgcagcactcaccgaactcac

SEQ ID NO: 114154 - DNA, 25 bp, mus musculus
cgaccacagggacgctgctgcccag

SEQ ID NO: 114155 - DNA, 25 bp, mus musculus
gaccacagggacgctgctgcccagg

SEQ ID NO: 114156 - DNA, 25 bp, mus musculus
tgctgcccagggtcctgctggccct

SEQ ID NO: 114157 - DNA, 25 bp, mus musculus
acccaacggcacgcggcacgcagaa

SEQ ID NO: 114158 - DNA, 25 bp, mus musculus
ccaacggcacgcggcacgcagaatt

SEQ ID NO: 114159 - DNA, 25 bp, mus musculus
caacggcacgcggcacgcagaattg

SEQ ID NO: 114160 - DNA, 25 bp, mus musculus
acggcacgcggcacgcagaattggg

SEQ ID NO: 114161 - DNA, 25 bp, mus musculus
gcacgcggcacgcagaattggggca

SEQ ID NO: 114162 - DNA, 25 bp, mus musculus
atttgctctcgctacttaggtctgt

SEQ ID NO: 114163 - DNA, 25 bp, mus musculus
tttgctctcgctacttaggtctgtg

SEQ ID NO: 114164 - DNA, 25 bp, mus musculus
tgctctcgctacttaggtctgtgcg

SEQ ID NO: 114165 - DNA, 25 bp, mus musculus
gctacttaggtctgtgcgcagcact

SEQ ID NO: 114166 - DNA, 25 bp, mus musculus
tacttaggtctgtgcgcagcactca

SEQ ID NO: 114167 - DNA, 25 bp, mus musculus
acttaggtctgtgcgcagcactcac

SEQ ID NO: 114168 - DNA, 25 bp, mus musculus
ttaggtctgtgcgcagcactcaccg

SEQ ID NO: 114169 - DNA, 25 bp, mus musculus
taggtctgtgcgcagcactcaccga

SEQ ID NO: 114170 - DNA, 25 bp, mus musculus
agcagcaagagccagacgtgtcctg

SEQ ID NO: 114171 - DNA, 25 bp, mus musculus
ccagacgtgtcctgctcgtaggcct

SEQ ID NO: 114172 - DNA, 25 bp, mus musculus
tggctctccaagaccctactagagg

SEQ ID NO: 114173 - DNA, 25 bp, mus musculus
ggctctccaagaccctactagaggt

SEQ ID NO: 114174 - DNA, 25 bp, mus musculus
gctctccaagaccctactagaggtg

SEQ ID NO: 114175 - DNA, 25 bp, mus musculus
ctctccaagaccctactagaggtgt

SEQ ID NO: 114176 - DNA, 25 bp, mus musculus
tctccaagaccctactagaggtgta

SEQ ID NO: 114177 - DNA, 25 bp, mus musculus
ctccaagaccctactagaggtgtag

SEQ ID NO: 114178 - DNA, 25 bp, mus musculus
tccaagaccctactagaggtgtagt

SEQ ID NO: 114179 - DNA, 25 bp, mus musculus
ttgttagtatacgctccacagcaca

SEQ ID NO: 114180 - DNA, 25 bp, mus musculus
tgttagtatacgctccacagcacat

SEQ ID NO: 114181 - DNA, 25 bp, mus musculus
acgtgtcctgctcgtaggcctccca

SEQ ID NO: 114182 - DNA, 25 bp, mus musculus
tgtcctgctcgtaggcctcccagga

SEQ ID NO: 114183 - DNA, 25 bp, mus musculus
gtcctgctcgtaggcctcccaggaa

SEQ ID NO: 114184 - DNA, 25 bp, mus musculus
tcctgctcgtaggcctcccaggaag

SEQ ID NO: 114185 - DNA, 25 bp, mus musculus
accacccttgctgactgagagtggc

SEQ ID NO: 114186 - DNA, 25 bp, mus musculus
gagtggctctccaagaccctactag

SEQ ID NO: 114187 - DNA, 25 bp, mus musculus
agtggctctccaagaccctactaga

SEQ ID NO: 114188 - DNA, 25 bp, mus musculus
gtggctctccaagaccctactagag

SEQ ID NO: 114189 - DNA, 25 bp, mus musculus
caaggaccccaagcggctctactgc

SEQ ID NO: 114190 - DNA, 25 bp, mus musculus
ggaccccaagcggctctactgcaag

SEQ ID NO: 114191 - DNA, 25 bp, mus musculus
gtgtgccaaccggtaccttgctatg

SEQ ID NO: 114192 - DNA, 25 bp, mus musculus
gtaccttgctatgaaggaagatgga

SEQ ID NO: 114193 - DNA, 25 bp, mus musculus
agatggacggctgctggcttctaag

SEQ ID NO: 114194 - DNA, 25 bp, mus musculus
gctgctggcttctaagtgtgttaca

SEQ ID NO: 114195 - DNA, 25 bp, mus musculus
tttcttctttgaacgactggaatct

SEQ ID NO: 114196 - DNA, 25 bp, mus musculus
cttctttgaacgactggaatctaat

SEQ ID NO: 114197 - DNA, 25 bp, mus musculus
atactccagttggtatgtggcactg

SEQ ID NO: 114198 - DNA, 25 bp, mus musculus
catactgtttcttccaatgtctgct

SEQ ID NO: 114199 - DNA, 25 bp, mus musculus
actgtttcttccaatgtctgctaag

SEQ ID NO: 114200 - DNA, 25 bp, mus musculus
gtttcttccaatgtctgctaagagc

SEQ ID NO: 114201 - DNA, 25 bp, mus musculus
caagcggctctactgcaagaacggc

SEQ ID NO: 114202 - DNA, 25 bp, mus musculus
tcttccaatgtctgctaagagctga

SEQ ID NO: 114203 - DNA, 25 bp, mus musculus
gcggctctactgcaagaacggcggc

SEQ ID NO: 114204 - DNA, 25 bp, mus musculus
gctctactgcaagaacggcggcttc

SEQ ID NO: 114205 - DNA, 25 bp, mus musculus
gaagagcgacccacacgtcaaacta

SEQ ID NO: 114206 - DNA, 25 bp, mus musculus
cgtcaaactacaactccaagcagaa

SEQ ID NO: 114207 - DNA, 25 bp, mus musculus
actacaactccaagcagaagagaga

SEQ ID NO: 114208 - DNA, 25 bp, mus musculus
acaactccaagcagaagagagagga

SEQ ID NO: 114209 - DNA, 25 bp, mus musculus
agttgtgtctatcaagggagtgtgt

SEQ ID NO: 114210 - DNA, 25 bp, mus musculus
catcctggcatccacaaggaggccc

SEQ ID NO: 114211 - DNA, 25 bp, mus musculus
atccacaaggaggcccagaggatcg

SEQ ID NO: 114212 - DNA, 25 bp, mus musculus
gaccatgcactcctggaggagcaga

SEQ ID NO: 114213 - DNA, 25 bp, mus musculus
catgcactcctggaggagcagagca

SEQ ID NO: 114214 - DNA, 25 bp, mus musculus
gcactcctggaggagcagagcaagc

SEQ ID NO: 114215 - DNA, 25 bp, mus musculus
agcaagcagcaatccaatgagcacc

SEQ ID NO: 114216 - DNA, 25 bp, mus musculus
cagcaatccaatgagcaccttcgcc

SEQ ID NO: 114217 - DNA, 25 bp, mus musculus
tccaatgagcaccttcgccgacagt

SEQ ID NO: 114218 - DNA, 25 bp, mus musculus
aatgagcaccttcgccgacagttcg

SEQ ID NO: 114219 - DNA, 25 bp, mus musculus
cttcgccgacagttcgccagccaag

SEQ ID NO: 114220 - DNA, 25 bp, mus musculus
cgacagttcgccagccaagccaata

SEQ ID NO: 114221 - DNA, 25 bp, mus musculus
ttcgccagccaagccaatatggtgg

SEQ ID NO: 114222 - DNA, 25 bp, mus musculus
gcccagaggatcgctgagagcaatc

SEQ ID NO: 114223 - DNA, 25 bp, mus musculus
agcaatcacatcaagctgtcgggca

SEQ ID NO: 114224 - DNA, 25 bp, mus musculus
cacatcaagctgtcgggcagcaatc

SEQ ID NO: 114225 - DNA, 25 bp, mus musculus
tcgggcagcaatccctacaccactg

SEQ ID NO: 114226 - DNA, 25 bp, mus musculus
ggcagcaatccctacaccactgtta

SEQ ID NO: 114227 - DNA, 25 bp, mus musculus
ccccagatcatcaactccaagtggg

SEQ ID NO: 114228 - DNA, 25 bp, mus musculus
atcaactccaagtgggagaaggtgc

SEQ ID NO: 114229 - DNA, 25 bp, mus musculus
cagcagctggtgccaaagagggacc

SEQ ID NO: 114230 - DNA, 25 bp, mus musculus
cattctgatgtgactcgagattgca

SEQ ID NO: 114231 - DNA, 25 bp, mus musculus
tgcagttgcaacttggcagcttttt

SEQ ID NO: 114232 - DNA, 25 bp, mus musculus
caaactctgaggactaccttacagc

SEQ ID NO: 114233 - DNA, 25 bp, mus musculus
aggactaccttacagctgacttaag

SEQ ID NO: 114234 - DNA, 25 bp, mus musculus
tttatgttcttctctgtgagaaggt

SEQ ID NO: 114235 - DNA, 25 bp, mus musculus
atgttcttctctgtgagaaggttta

SEQ ID NO: 114236 - DNA, 25 bp, mus musculus
ttcttctctgtgagaaggtttattg

SEQ ID NO: 114237 - DNA, 25 bp, mus musculus
ctcctgccaatataaccagctaata

SEQ ID NO: 114238 - DNA, 25 bp, mus musculus
atataaccagctaatattgtcgatg

SEQ ID NO: 114239 - DNA, 25 bp, mus musculus
ccataaacaagttcaggccaaagtg

SEQ ID NO: 114240 - DNA, 25 bp, mus musculus
tttaggattacctaacattgctggt

SEQ ID NO: 114241 - DNA, 25 bp, mus musculus
attacctaacattgctggtaaatat

SEQ ID NO: 114242 - DNA, 25 bp, mus musculus
ttctactggacaggaagatggcaga

SEQ ID NO: 114243 - DNA, 25 bp, mus musculus
aagctacgctattgtcatagcaaaa

SEQ ID NO: 114244 - DNA, 25 bp, mus musculus
ctacgctattgtcatagcaaaagag

SEQ ID NO: 114245 - DNA, 25 bp, mus musculus
gctttctatttggcacataccaggg

SEQ ID NO: 114246 - DNA, 25 bp, mus musculus
ttctatttggcacataccaggggtc

SEQ ID NO: 114247 - DNA, 25 bp, mus musculus
ttggcacataccaggggtccagcta

SEQ ID NO: 114248 - DNA, 25 bp, mus musculus
cataccaggggtccagctactggaa

SEQ ID NO: 114249 - DNA, 25 bp, mus musculus
ggtccagctactggaagggctctac

SEQ ID NO: 114250 - DNA, 25 bp, mus musculus
aatcattttctgtcactcatttaaa

SEQ ID NO: 114251 - DNA, 25 bp, mus musculus
gataatctctaatctgtttattgaa

SEQ ID NO: 114252 - DNA, 25 bp, mus musculus
aatccagttgatttgcctgtcacga

SEQ ID NO: 114253 - DNA, 25 bp, mus musculus
gttgatttgcctgtcacgaaacgag

SEQ ID NO: 114254 - DNA, 25 bp, mus musculus
gaaagccatctctctgaaaagtagt

SEQ ID NO: 114255 - DNA, 25 bp, mus musculus
taacgcagcaaatgtcctcagttct

SEQ ID NO: 114256 - DNA, 25 bp, mus musculus
agcaaatgtcctcagttctctggtg

SEQ ID NO: 114257 - DNA, 25 bp, mus musculus
ggacagagctcgtgtgcgaggctca

SEQ ID NO: 114258 - DNA, 25 bp, mus musculus
cattagaatcccaggatgggctgga

SEQ ID NO: 114259 - DNA, 25 bp, mus musculus
aatcccaggatgggctggacctgga

SEQ ID NO: 114260 - DNA, 25 bp, mus musculus
atgcaatttccatgaactcttgttt

SEQ ID NO: 114261 - DNA, 25 bp, mus musculus
tttccatgaactcttgtttaagatt

SEQ ID NO: 114262 - DNA, 25 bp, mus musculus
caattcactgatatatgctgatgtt

SEQ ID NO: 114263 - DNA, 25 bp, mus musculus
actatttgccaatatgtatttttag

SEQ ID NO: 114264 - DNA, 25 bp, mus musculus
tggcttcatttgggtggctagcact

SEQ ID NO: 114265 - DNA, 25 bp, mus musculus
tgatcttaatgatcactttattgct

SEQ ID NO: 114266 - DNA, 25 bp, mus musculus
taatgatcactttattgctgaacat

SEQ ID NO: 114267 - DNA, 25 bp, mus musculus
tcactttattgctgaacatcattat

SEQ ID NO: 114268 - DNA, 25 bp, mus musculus
tattgctgaacatcattattcttta

SEQ ID NO: 114269 - DNA, 25 bp, mus musculus
taatttcttaggaatccagttgatt

SEQ ID NO: 114270 - DNA, 25 bp, mus musculus
tcgcaatccggacctctcatcacga

SEQ ID NO: 114271 - DNA, 25 bp, mus musculus
caatccggacctctcatcacgagca

SEQ ID NO: 114272 - DNA, 25 bp, mus musculus
caccttaggcgatgacctgggcgtg

SEQ ID NO: 114273 - DNA, 25 bp, mus musculus
agagtgtcagcgtcctcactaatcg

SEQ ID NO: 114274 - DNA, 25 bp, mus musculus
gtgtcagcgtcctcactaatcgctc

SEQ ID NO: 114275 - DNA, 25 bp, mus musculus
tcagcgtcctcactaatcgctcctt

SEQ ID NO: 114276 - DNA, 25 bp, mus musculus
tcactaatcgctccttgttaccatg

SEQ ID NO: 114277 - DNA, 25 bp, mus musculus
gctccttgttaccatggtaactagc

SEQ ID NO: 114278 - DNA, 25 bp, mus musculus
ggtaactagcgacacgcctccacgc

SEQ ID NO: 114279 - DNA, 25 bp, mus musculus
acgcacgcgcattagcgtctggtcg

SEQ ID NO: 114280 - DNA, 25 bp, mus musculus
cacgcgcattagcgtctggtcggcc

SEQ ID NO: 114281 - DNA, 25 bp, mus musculus
gcgcattagcgtctggtcggccgct

SEQ ID NO: 114282 - DNA, 25 bp, mus musculus
ctcatcacgagcaacctgggagtct

SEQ ID NO: 114283 - DNA, 25 bp, mus musculus
tagcgtctggtcggccgctgcttcc

SEQ ID NO: 114284 - DNA, 25 bp, mus musculus
atcacgagcaacctgggagtctgag

SEQ ID NO: 114285 - DNA, 25 bp, mus musculus
agcaacctgggagtctgagaagctg

SEQ ID NO: 114286 - DNA, 25 bp, mus musculus
tccggacagcgcagtgaccacagtc

SEQ ID NO: 114287 - DNA, 25 bp, mus musculus
agtgaccacagtccctatcgtgacg

SEQ ID NO: 114288 - DNA, 25 bp, mus musculus
cacagtccctatcgtgacggtccgg

SEQ ID NO: 114289 - DNA, 25 bp, mus musculus
aggagcgctcaccttaggcgatgac

SEQ ID NO: 114290 - DNA, 25 bp, mus musculus
agcgctcaccttaggcgatgacctg

SEQ ID NO: 114291 - DNA, 25 bp, mus musculus
agcctctgaccattctgattccagt

SEQ ID NO: 114292 - DNA, 25 bp, mus musculus
ccattctgattccagtgacacttgt

SEQ ID NO: 114293 - DNA, 25 bp, mus musculus
aactgatagcctcaaactccaaaca

SEQ ID NO: 114294 - DNA, 25 bp, mus musculus
tgatagcctcaaactccaaacacca

SEQ ID NO: 114295 - DNA, 25 bp, mus musculus
aacaccataggtaggacacgaagct

SEQ ID NO: 114296 - DNA, 25 bp, mus musculus
attgtgacctgagtgactctctgtc

SEQ ID NO: 114297 - DNA, 25 bp, mus musculus
gtgactctctgtcagaacaaacaaa

SEQ ID NO: 114298 - DNA, 25 bp, mus musculus
aatgtggtcaaatccctgttggtga

SEQ ID NO: 114299 - DNA, 25 bp, mus musculus
gaagtgcttgctgcttctttgatta

SEQ ID NO: 114300 - DNA, 25 bp, mus musculus
gcttctttgattatgactggtttgg

SEQ ID NO: 114301 - DNA, 25 bp, mus musculus
gttacatgtttgcacctttctagtt

SEQ ID NO: 114302 - DNA, 25 bp, mus musculus
tgtttgcacctttctagttgaaaat

SEQ ID NO: 114303 - DNA, 25 bp, mus musculus
ttctgattccagtgacacttgtcag

SEQ ID NO: 114304 - DNA, 25 bp, mus musculus
tgattccagtgacacttgtcaggag

SEQ ID NO: 114305 - DNA, 25 bp, mus musculus
cagtgacacttgtcaggagtcagag

SEQ ID NO: 114306 - DNA, 25 bp, mus musculus
tgacacttgtcaggagtcagagcct

SEQ ID NO: 114307 - DNA, 25 bp, mus musculus
gtcagagccttgtctgttagactgg

SEQ ID NO: 114308 - DNA, 25 bp, mus musculus
gccttgtctgttagactggacagct

SEQ ID NO: 114309 - DNA, 25 bp, mus musculus
agtttgcctgtaacaagccagattt

SEQ ID NO: 114310 - DNA, 25 bp, mus musculus
ttgcctgtaacaagccagattttta

SEQ ID NO: 114311 - DNA, 25 bp, mus musculus
ccactccgcactgggaatggcagct

SEQ ID NO: 114312 - DNA, 25 bp, mus musculus
actccgcactgggaatggcagcttg

SEQ ID NO: 114313 - DNA, 25 bp, mus musculus
atcacagaacaactgatcgaagcca

SEQ ID NO: 114314 - DNA, 25 bp, mus musculus
aagatttgtgacccgggcctcacat

SEQ ID NO: 114315 - DNA, 25 bp, mus musculus
gacccgggcctcacatcctttgagc

SEQ ID NO: 114316 - DNA, 25 bp, mus musculus
ccgggcctcacatcctttgagccag

SEQ ID NO: 114317 - DNA, 25 bp, mus musculus
gggcctcacatcctttgagccagaa

SEQ ID NO: 114318 - DNA, 25 bp, mus musculus
ggcctcacatcctttgagccagaag

SEQ ID NO: 114319 - DNA, 25 bp, mus musculus
cacatcctttgagccagaagccctt

SEQ ID NO: 114320 - DNA, 25 bp, mus musculus
acatcctttgagccagaagcccttg

SEQ ID NO: 114321 - DNA, 25 bp, mus musculus
tcctttgagccagaagcccttggta

SEQ ID NO: 114322 - DNA, 25 bp, mus musculus
tggtaacctcgtggaaggaatggat

SEQ ID NO: 114323 - DNA, 25 bp, mus musculus
ctccgcactgggaatggcagcttgg

SEQ ID NO: 114324 - DNA, 25 bp, mus musculus
ttttactttgagaatctcctgtcca

SEQ ID NO: 114325 - DNA, 25 bp, mus musculus
aatggcagcttggtgcctgaaggac

SEQ ID NO: 114326 - DNA, 25 bp, mus musculus
cagcttggtgcctgaaggacggagc

SEQ ID NO: 114327 - DNA, 25 bp, mus musculus
agcttggtgcctgaaggacggagcc

SEQ ID NO: 114328 - DNA, 25 bp, mus musculus
tctctgctcctcagccatgagaaaa

SEQ ID NO: 114329 - DNA, 25 bp, mus musculus
ctgctcctcagccatgagaaaacaa

SEQ ID NO: 114330 - DNA, 25 bp, mus musculus
ctcctcagccatgagaaaacaagaa

SEQ ID NO: 114331 - DNA, 25 bp, mus musculus
taagatcacagaacaactgatcgaa

SEQ ID NO: 114332 - DNA, 25 bp, mus musculus
cttgtaacaactgcctatttctatg

SEQ ID NO: 114333 - DNA, 25 bp, mus musculus
agcagctgaactttctaggaatact

SEQ ID NO: 114334 - DNA, 25 bp, mus musculus
cgacccatttctcatctgagacttg

SEQ ID NO: 114335 - DNA, 25 bp, mus musculus
tacttatctggacctttgtagtgat

SEQ ID NO: 114336 - DNA, 25 bp, mus musculus
tctggacctttgtagtgatgcataa

SEQ ID NO: 114337 - DNA, 25 bp, mus musculus
tcctacttcattactgctgactctg

SEQ ID NO: 114338 - DNA, 25 bp, mus musculus
actgctgactctgctaacgttccac

SEQ ID NO: 114339 - DNA, 25 bp, mus musculus
gactctgctaacgttccactacttg

SEQ ID NO: 114340 - DNA, 25 bp, mus musculus
gctaacgttccactacttgttgcct

SEQ ID NO: 114341 - DNA, 25 bp, mus musculus
gttccactacttgttgcctcttttg

SEQ ID NO: 114342 - DNA, 25 bp, mus musculus
gttgcctcttttgtcttgcaagaag

SEQ ID NO: 114343 - DNA, 25 bp, mus musculus
tcttttgtcttgcaagaagtatcaa

SEQ ID NO: 114344 - DNA, 25 bp, mus musculus
ttcaacagtgcatcttcagccttct

SEQ ID NO: 114345 - DNA, 25 bp, mus musculus
tatcaataaacatctttccagattt

SEQ ID NO: 114346 - DNA, 25 bp, mus musculus
tccaacctacctaagggtcatgtct

SEQ ID NO: 114347 - DNA, 25 bp, mus musculus
ctacctaagggtcatgtctctcaca

SEQ ID NO: 114348 - DNA, 25 bp, mus musculus
aagggtcatgtctctcacagcaggc

SEQ ID NO: 114349 - DNA, 25 bp, mus musculus
agcaggctcaaggctgcaagagtca

SEQ ID NO: 114350 - DNA, 25 bp, mus musculus
attgcaaatggccaactgacttgcc

SEQ ID NO: 114351 - DNA, 25 bp, mus musculus
caactgacttgcccatttatggttt

SEQ ID NO: 114352 - DNA, 25 bp, mus musculus
atgctgaccatccgacccatttctc

SEQ ID NO: 114353 - DNA, 25 bp, mus musculus
ttacctgatacagtggcattatagc

SEQ ID NO: 114354 - DNA, 25 bp, mus musculus
gtgaaactatccacgctgttaggtt

SEQ ID NO: 114355 - DNA, 25 bp, mus musculus
tggctttgtgcttcctgtagatctc

SEQ ID NO: 114356 - DNA, 25 bp, mus musculus
ctttgtgcttcctgtagatctccag

SEQ ID NO: 114357 - DNA, 25 bp, mus musculus
tgtgcttcctgtagatctccaggaa

SEQ ID NO: 114358 - DNA, 25 bp, mus musculus
tcctgtagatctccaggaactcctg

SEQ ID NO: 114359 - DNA, 25 bp, mus musculus
agatctccaggaactcctgcacatc

SEQ ID NO: 114360 - DNA, 25 bp, mus musculus
tctccaggaactcctgcacatcttc

SEQ ID NO: 114361 - DNA, 25 bp, mus musculus
ccaggaactcctgcacatcttcaga

SEQ ID NO: 114362 - DNA, 25 bp, mus musculus
cctgcacatcttcagaggaccccat

SEQ ID NO: 114363 - DNA, 25 bp, mus musculus
catcttcagaggaccccatgacgac

SEQ ID NO: 114364 - DNA, 25 bp, mus musculus
tgacgactggtgccttctggtggat

SEQ ID NO: 114365 - DNA, 25 bp, mus musculus
tccacgctgttaggtttgtttctag

SEQ ID NO: 114366 - DNA, 25 bp, mus musculus
atgtacaacatgcagaatggagtag

SEQ ID NO: 114367 - DNA, 25 bp, mus musculus
gtagcgtcacttgagctctgctctg

SEQ ID NO: 114368 - DNA, 25 bp, mus musculus
gcgtcacttgagctctgctctgggg

SEQ ID NO: 114369 - DNA, 25 bp, mus musculus
tcacttgagctctgctctggggcag

SEQ ID NO: 114370 - DNA, 25 bp, mus musculus
gccttcacttggctttgtgcttcct

SEQ ID NO: 114371 - DNA, 25 bp, mus musculus
ttcacttggctttgtgcttcctgta

SEQ ID NO: 114372 - DNA, 25 bp, mus musculus
acttggctttgtgcttcctgtagat

SEQ ID NO: 114373 - DNA, 25 bp, mus musculus
ccagagacccctgtctgatcaaccg

SEQ ID NO: 114374 - DNA, 25 bp, mus musculus
gtctgatcaaccggagttcgtgtaa

SEQ ID NO: 114375 - DNA, 25 bp, mus musculus
aactcagcctagggagccacagcga

SEQ ID NO: 114376 - DNA, 25 bp, mus musculus
acagcgactgctccgctcagaaact

SEQ ID NO: 114377 - DNA, 25 bp, mus musculus
actgctccgctcagaaacttcagct

SEQ ID NO: 114378 - DNA, 25 bp, mus musculus
ccgctcagaaacttcagctggaacc

SEQ ID NO: 114379 - DNA, 25 bp, mus musculus
ctcagaaacttcagctggaaccctt

SEQ ID NO: 114380 - DNA, 25 bp, mus musculus
ttcagctggaacccttttagagcct

SEQ ID NO: 114381 - DNA, 25 bp, mus musculus
agctggaacccttttagagcctgct

SEQ ID NO: 114382 - DNA, 25 bp, mus musculus
tggaacccttttagagcctgctcac

SEQ ID NO: 114383 - DNA, 25 bp, mus musculus
ccttttagagcctgctcacgtcggc

SEQ ID NO: 114384 - DNA, 25 bp, mus musculus
agagcctgctcacgtcggctcgggg

SEQ ID NO: 114385 - DNA, 25 bp, mus musculus
gccacgggcaccatcctgcagtttg

SEQ ID NO: 114386 - DNA, 25 bp, mus musculus
acgggcaccatcctgcagtttgtca

SEQ ID NO: 114387 - DNA, 25 bp, mus musculus
accatcctgcagtttgtcaacggca

SEQ ID NO: 114388 - DNA, 25 bp, mus musculus
gtcaacggcatgaaccagcagcttg

SEQ ID NO: 114389 - DNA, 25 bp, mus musculus
atgaaccagcagcttggaaactcag

SEQ ID NO: 114390 - DNA, 25 bp, mus musculus
aaccagcagcttggaaactcagcct

SEQ ID NO: 114391 - DNA, 25 bp, mus musculus
cttggaaactcagcctagggagcca

SEQ ID NO: 114392 - DNA, 25 bp, mus musculus
ggaaactcagcctagggagccacag

SEQ ID NO: 114393 - DNA, 25 bp, mus musculus
tgaggctgagctggatcctgacaat

SEQ ID NO: 114394 - DNA, 25 bp, mus musculus
gctggatcctgacaatactgtccat

SEQ ID NO: 114395 - DNA, 25 bp, mus musculus
tctcccttggcactggccaggttat

SEQ ID NO: 114396 - DNA, 25 bp, mus musculus
gcactggccaggttatcaagggctg

SEQ ID NO: 114397 - DNA, 25 bp, mus musculus
agttggtgatcccatccgagctggg

SEQ ID NO: 114398 - DNA, 25 bp, mus musculus
tgatcccatccgagctggggtatgg

SEQ ID NO: 114399 - DNA, 25 bp, mus musculus
tcccaggtggagcaaccctggtgtt

SEQ ID NO: 114400 - DNA, 25 bp, mus musculus
gtggagcaaccctggtgtttgaggt

SEQ ID NO: 114401 - DNA, 25 bp, mus musculus
caaccctggtgtttgaggtggagct

SEQ ID NO: 114402 - DNA, 25 bp, mus musculus
ccctggtgtttgaggtggagctgct

SEQ ID NO: 114403 - DNA, 25 bp, mus musculus
agagacgctcagaactgtagcaggc

SEQ ID NO: 114404 - DNA, 25 bp, mus musculus
cccccaagagtgagtctgtatttct

SEQ ID NO: 114405 - DNA, 25 bp, mus musculus
ggatcctgacaatactgtccatttg

SEQ ID NO: 114406 - DNA, 25 bp, mus musculus
caatactgtccatttgcctgagtgc

SEQ ID NO: 114407 - DNA, 25 bp, mus musculus
tactgtccatttgcctgagtgccct

SEQ ID NO: 114408 - DNA, 25 bp, mus musculus
gtcctatcaagtctagaaagggaga

SEQ ID NO: 114409 - DNA, 25 bp, mus musculus
atgtcttacacatgcactacacggg

SEQ ID NO: 114410 - DNA, 25 bp, mus musculus
agtttgacagcagcctaccacagaa

SEQ ID NO: 114411 - DNA, 25 bp, mus musculus
ttgacagcagcctaccacagaacca

SEQ ID NO: 114412 - DNA, 25 bp, mus musculus
ttttctcccttggcactggccaggt

SEQ ID NO: 114413 - DNA, 25 bp, mus musculus
caatactcatgtgtgtgggcaaaaa

SEQ ID NO: 114414 - DNA, 25 bp, mus musculus
gcaaaaactccaggactgtatttgt

SEQ ID NO: 114415 - DNA, 25 bp, mus musculus
tgtcttcaaaaaccttgatgtcgtt

SEQ ID NO: 114416 - DNA, 25 bp, mus musculus
tgtcgttaaactgccagttactatt

SEQ ID NO: 114417 - DNA, 25 bp, mus musculus
gggtcatccaagcaaggtcacaatt

SEQ ID NO: 114418 - DNA, 25 bp, mus musculus
tcatccaagcaaggtcacaatttgg

SEQ ID NO: 114419 - DNA, 25 bp, mus musculus
tggttgttggcacaccctatgcaat

SEQ ID NO: 114420 - DNA, 25 bp, mus musculus
ttgttggcacaccctatgcaatatc

SEQ ID NO: 114421 - DNA, 25 bp, mus musculus
caccctatgcaatatcaaaattgaa

SEQ ID NO: 114422 - DNA, 25 bp, mus musculus
tatgtatccattatcatgtgtactc

SEQ ID NO: 114423 - DNA, 25 bp, mus musculus
gtatccattatcatgtgtactcaat

SEQ ID NO: 114424 - DNA, 25 bp, mus musculus
attatcatgtgtactcaataaacga

SEQ ID NO: 114425 - DNA, 25 bp, mus musculus
actccaggactgtatttgtgactaa

SEQ ID NO: 114426 - DNA, 25 bp, mus musculus
actgtagacctttttcacccatgct

SEQ ID NO: 114427 - DNA, 25 bp, mus musculus
gtagacctttttcacccatgctgtt

SEQ ID NO: 114428 - DNA, 25 bp, mus musculus
gacctttttcacccatgctgttgat

SEQ ID NO: 114429 - DNA, 25 bp, mus musculus
cacccatgctgttgattgctaaatg

SEQ ID NO: 114430 - DNA, 25 bp, mus musculus
agtctattctgaagccatcttggta

SEQ ID NO: 114431 - DNA, 25 bp, mus musculus
ctattctgaagccatcttggtaaac

SEQ ID NO: 114432 - DNA, 25 bp, mus musculus
tggtgccaagttccatttggaattt

SEQ ID NO: 114433 - DNA, 25 bp, mus musculus
tgtcagctggcagaggcagaagaag

SEQ ID NO: 114434 - DNA, 25 bp, mus musculus
ggcaacgtcccagaacatccatcca

SEQ ID NO: 114435 - DNA, 25 bp, mus musculus
cctacaggccgttgcttcgctggac

SEQ ID NO: 114436 - DNA, 25 bp, mus musculus
cgttgcttcgctggacttttctcta

SEQ ID NO: 114437 - DNA, 25 bp, mus musculus
tgcttcgctggacttttctctagat

SEQ ID NO: 114438 - DNA, 25 bp, mus musculus
ttcgctggacttttctctagatgct

SEQ ID NO: 114439 - DNA, 25 bp, mus musculus
cttttctctagatgctgtctgccat

SEQ ID NO: 114440 - DNA, 25 bp, mus musculus
ttctctagatgctgtctgccattac

SEQ ID NO: 114441 - DNA, 25 bp, mus musculus
tgctgtctgccattactccaaagtg

SEQ ID NO: 114442 - DNA, 25 bp, mus musculus
ccattactccaaagtgacttctata

SEQ ID NO: 114443 - DNA, 25 bp, mus musculus
ctccaaagtgacttctataaaatca

SEQ ID NO: 114444 - DNA, 25 bp, mus musculus
ccccaggcttgaggggaaagccatg

SEQ ID NO: 114445 - DNA, 25 bp, mus musculus
taccaaaacaggcggcccctcagca

SEQ ID NO: 114446 - DNA, 25 bp, mus musculus
ccatcgccacaggcccaggtgaaga

SEQ ID NO: 114447 - DNA, 25 bp, mus musculus
tcgccacaggcccaggtgaagattc

SEQ ID NO: 114448 - DNA, 25 bp, mus musculus
ctgtagaccgcagagccaagattag

SEQ ID NO: 114449 - DNA, 25 bp, mus musculus
ttagcctcgcctctgaggaagcgcc

SEQ ID NO: 114450 - DNA, 25 bp, mus musculus
gcctcgcctctgaggaagcgcccta

SEQ ID NO: 114451 - DNA, 25 bp, mus musculus
aggaagcgccctacaggccgttgct

SEQ ID NO: 114452 - DNA, 25 bp, mus musculus
cgccctacaggccgttgcttcgctg

SEQ ID NO: 114453 - DNA, 25 bp, mus musculus
gcacgccagcaagatggcggcgcca

SEQ ID NO: 114454 - DNA, 25 bp, mus musculus
acgccagcaagatggcggcgccagc

SEQ ID NO: 114455 - DNA, 25 bp, mus musculus
ccgacgacctggtgactgacgcgcg

SEQ ID NO: 114456 - DNA, 25 bp, mus musculus
cgacgacctggtgactgacgcgcgg

SEQ ID NO: 114457 - DNA, 25 bp, mus musculus
ccgcgcgcaaggcatagagacgaca

SEQ ID NO: 114458 - DNA, 25 bp, mus musculus
gggcctgcgtggacttcaagtcgtg

SEQ ID NO: 114459 - DNA, 25 bp, mus musculus
ggcctgcgtggacttcaagtcgtgg

SEQ ID NO: 114460 - DNA, 25 bp, mus musculus
cctgcgtggacttcaagtcgtggat

SEQ ID NO: 114461 - DNA, 25 bp, mus musculus
gcgtggacttcaagtcgtggatgcg

SEQ ID NO: 114462 - DNA, 25 bp, mus musculus
cgtggacttcaagtcgtggatgcgg

SEQ ID NO: 114463 - DNA, 25 bp, mus musculus
tggacttcaagtcgtggatgcggac

SEQ ID NO: 114464 - DNA, 25 bp, mus musculus
acttcaagtcgtggatgcggaccca

SEQ ID NO: 114465 - DNA, 25 bp, mus musculus
gcgctccgagatgaccgacgacctg

SEQ ID NO: 114466 - DNA, 25 bp, mus musculus
gctccgagatgaccgacgacctggt

SEQ ID NO: 114467 - DNA, 25 bp, mus musculus
ccgagatgaccgacgacctggtgac

SEQ ID NO: 114468 - DNA, 25 bp, mus musculus
cgagatgaccgacgacctggtgact

SEQ ID NO: 114469 - DNA, 25 bp, mus musculus
agatgaccgacgacctggtgactga

SEQ ID NO: 114470 - DNA, 25 bp, mus musculus
gatgaccgacgacctggtgactgac

SEQ ID NO: 114471 - DNA, 25 bp, mus musculus
tgaccgacgacctggtgactgacgc

SEQ ID NO: 114472 - DNA, 25 bp, mus musculus
gaccgacgacctggtgactgacgcg

SEQ ID NO: 114473 - DNA, 25 bp, mus musculus
tggtggccacacttctgggttcaaa

SEQ ID NO: 114474 - DNA, 25 bp, mus musculus
tggccacacttctgggttcaaagtg

SEQ ID NO: 114475 - DNA, 25 bp, mus musculus
aactctcttaccgctgcgagtatga

SEQ ID NO: 114476 - DNA, 25 bp, mus musculus
cttaccgctgcgagtatgactttgt

SEQ ID NO: 114477 - DNA, 25 bp, mus musculus
accgctgcgagtatgactttgtcaa

SEQ ID NO: 114478 - DNA, 25 bp, mus musculus
agttgagctcagggaccaaggtgct

SEQ ID NO: 114479 - DNA, 25 bp, mus musculus
tgagctcagggaccaaggtgctggc

SEQ ID NO: 114480 - DNA, 25 bp, mus musculus
tgctggccacactgtgtgggcagga

SEQ ID NO: 114481 - DNA, 25 bp, mus musculus
ccacactgtgtgggcaggagagtac

SEQ ID NO: 114482 - DNA, 25 bp, mus musculus
gtacagacactgagcaggcacctgg

SEQ ID NO: 114483 - DNA, 25 bp, mus musculus
cagacactgagcaggcacctggcaa

SEQ ID NO: 114484 - DNA, 25 bp, mus musculus
acactgagcaggcacctggcaatga

SEQ ID NO: 114485 - DNA, 25 bp, mus musculus
ctgaacctgtattcgggcgcctggt

SEQ ID NO: 114486 - DNA, 25 bp, mus musculus
ctgagcaggcacctggcaatgacac

SEQ ID NO: 114487 - DNA, 25 bp, mus musculus
agtatgctgaccatcaagatcgatc

SEQ ID NO: 114488 - DNA, 25 bp, mus musculus
atgctgaccatcaagatcgatcctg

SEQ ID NO: 114489 - DNA, 25 bp, mus musculus
accatcaagatcgatcctggacact

SEQ ID NO: 114490 - DNA, 25 bp, mus musculus
atcaagatcgatcctggacactgac

SEQ ID NO: 114491 - DNA, 25 bp, mus musculus
aagatcgatcctggacactgactgc

SEQ ID NO: 114492 - DNA, 25 bp, mus musculus
tcacccactttgacctggaactctc

SEQ ID NO: 114493 - DNA, 25 bp, mus musculus
tggaactctcttaccgctgcgagta

SEQ ID NO: 114494 - DNA, 25 bp, mus musculus
tacatattagcgacaacagattgga

SEQ ID NO: 114495 - DNA, 25 bp, mus musculus
atattagcgacaacagattggattt

SEQ ID NO: 114496 - DNA, 25 bp, mus musculus
atttcacatgtcaaaggaggttagc

SEQ ID NO: 114497 - DNA, 25 bp, mus musculus
attggtacacagtcacaatgtaccg

SEQ ID NO: 114498 - DNA, 25 bp, mus musculus
agcaaggcgctaacttgcttaaatg

SEQ ID NO: 114499 - DNA, 25 bp, mus musculus
aaggcgctaacttgcttaaatgtga

SEQ ID NO: 114500 - DNA, 25 bp, mus musculus
gcgctaacttgcttaaatgtgaatt

SEQ ID NO: 114501 - DNA, 25 bp, mus musculus
taatttgattcacatcttttcaaat

SEQ ID NO: 114502 - DNA, 25 bp, mus musculus
tttgattcacatcttttcaaatgga

SEQ ID NO: 114503 - DNA, 25 bp, mus musculus
gattcacatcttttcaaatggagtt

SEQ ID NO: 114504 - DNA, 25 bp, mus musculus
tcacatcttttcaaatggagttgga

SEQ ID NO: 114505 - DNA, 25 bp, mus musculus
catcttttcaaatggagttggagtt

SEQ ID NO: 114506 - DNA, 25 bp, mus musculus
taaagtttgatcttcctctgctaaa

SEQ ID NO: 114507 - DNA, 25 bp, mus musculus
agtttgatcttcctctgctaaattg

SEQ ID NO: 114508 - DNA, 25 bp, mus musculus
ttgatcttcctctgctaaattgatg

SEQ ID NO: 114509 - DNA, 25 bp, mus musculus
atcttcctctgctaaattgatgttg

SEQ ID NO: 114510 - DNA, 25 bp, mus musculus
ttcctctgctaaattgatgttgatg

SEQ ID NO: 114511 - DNA, 25 bp, mus musculus
gttgatgcaatccttacaatgattg

SEQ ID NO: 114512 - DNA, 25 bp, mus musculus
gcaatccttacaatgattgctttta

SEQ ID NO: 114513 - DNA, 25 bp, mus musculus
gaaatttcacatgtcaaaggaggtt

SEQ ID NO: 114514 - DNA, 25 bp, mus musculus
aagccttttgctctggagcctagtt

SEQ ID NO: 114515 - DNA, 25 bp, mus musculus
tttgctctggagcctagttctcagc

SEQ ID NO: 114516 - DNA, 25 bp, mus musculus
tgttctgcttcagggtttcagtact

SEQ ID NO: 114517 - DNA, 25 bp, mus musculus
cagtactgctcagtgttgtttaaga

SEQ ID NO: 114518 - DNA, 25 bp, mus musculus
ctgaatgctagtacccaagacctga

SEQ ID NO: 114519 - DNA, 25 bp, mus musculus
gctagtacccaagacctgagcaagg

SEQ ID NO: 114520 - DNA, 25 bp, mus musculus
gaaagtcacccagacacctctgctt

SEQ ID NO: 114521 - DNA, 25 bp, mus musculus
ttcttttgccatctgacctgcagca

SEQ ID NO: 114522 - DNA, 25 bp, mus musculus
aactcactttgtcccaacaattcag

SEQ ID NO: 114523 - DNA, 25 bp, mus musculus
ctttgtcccaacaattcagattgcc

SEQ ID NO: 114524 - DNA, 25 bp, mus musculus
cccaacaattcagattgcctagaaa

SEQ ID NO: 114525 - DNA, 25 bp, mus musculus
aattcagattgcctagaaatacctt

SEQ ID NO: 114526 - DNA, 25 bp, mus musculus
cctagttctcagcttcagcacaatt

SEQ ID NO: 114527 - DNA, 25 bp, mus musculus
tctcagcttcagcacaatttacagc

SEQ ID NO: 114528 - DNA, 25 bp, mus musculus
cttcagcacaatttacagcttctcc

SEQ ID NO: 114529 - DNA, 25 bp, mus musculus
cacaatttacagcttctccaagcat

SEQ ID NO: 114530 - DNA, 25 bp, mus musculus
tcgccccgtgggatgtttgagactt

SEQ ID NO: 114531 - DNA, 25 bp, mus musculus
atgtttgagacttctctcctcaatg

SEQ ID NO: 114532 - DNA, 25 bp, mus musculus
tctctcctcaatggtgacagttggt

SEQ ID NO: 114533 - DNA, 25 bp, mus musculus
agttggtcaccctgttctgcttcag

SEQ ID NO: 114534 - DNA, 25 bp, mus musculus
tctctatttccagctggcttttctg

SEQ ID NO: 114535 - DNA, 25 bp, mus musculus
tccagctggcttttctgattttcag

SEQ ID NO: 114536 - DNA, 25 bp, mus musculus
aagcaccaacagcatagcccaagcc

SEQ ID NO: 114537 - DNA, 25 bp, mus musculus
caacagcatagcccaagccaggaga

SEQ ID NO: 114538 - DNA, 25 bp, mus musculus
agcatagcccaagccaggagaactg

SEQ ID NO: 114539 - DNA, 25 bp, mus musculus
catagcccaagccaggagaactgtg

SEQ ID NO: 114540 - DNA, 25 bp, mus musculus
gcccaagccaggagaactgtgcagc

SEQ ID NO: 114541 - DNA, 25 bp, mus musculus
agaactgtgcagcagctgagattgg

SEQ ID NO: 114542 - DNA, 25 bp, mus musculus
aactgtgcagcagctgagattggaa

SEQ ID NO: 114543 - DNA, 25 bp, mus musculus
agattggaagcctccatcgaaagaa

SEQ ID NO: 114544 - DNA, 25 bp, mus musculus
attggaagcctccatcgaaagaata

SEQ ID NO: 114545 - DNA, 25 bp, mus musculus
gaagcctccatcgaaagaataaagg

SEQ ID NO: 114546 - DNA, 25 bp, mus musculus
gctggcttttctgattttcagaaag

SEQ ID NO: 114547 - DNA, 25 bp, mus musculus
gtctcaaaagcatcagcagacctga

SEQ ID NO: 114548 - DNA, 25 bp, mus musculus
tggcttttctgattttcagaaagaa

SEQ ID NO: 114549 - DNA, 25 bp, mus musculus
aagatgtccagcaagacggcaagca

SEQ ID NO: 114550 - DNA, 25 bp, mus musculus
gatgtccagcaagacggcaagcacc

SEQ ID NO: 114551 - DNA, 25 bp, mus musculus
tccagcaagacggcaagcaccaaca

SEQ ID NO: 114552 - DNA, 25 bp, mus musculus
aagacggcaagcaccaacagcatag

SEQ ID NO: 114553 - DNA, 25 bp, mus musculus
gacggcaagcaccaacagcatagcc

SEQ ID NO: 114554 - DNA, 25 bp, mus musculus
gcaagcaccaacagcatagcccaag

SEQ ID NO: 114555 - DNA, 25 bp, mus musculus
aatcccacgagtcagatttctattt

SEQ ID NO: 114556 - DNA, 25 bp, mus musculus
cccgtgctgcatggaacattccata

SEQ ID NO: 114557 - DNA, 25 bp, mus musculus
tctccctttatcctttctcaagtct

SEQ ID NO: 114558 - DNA, 25 bp, mus musculus
ctttctcaagtctgtctcgctcaga

SEQ ID NO: 114559 - DNA, 25 bp, mus musculus
gctcagaccacttccaacatgtctc

SEQ ID NO: 114560 - DNA, 25 bp, mus musculus
tccaacatgtctccactctcaatga

SEQ ID NO: 114561 - DNA, 25 bp, mus musculus
atgtctccactctcaatgactctga

SEQ ID NO: 114562 - DNA, 25 bp, mus musculus
ccactctcaatgactctgatctccg

SEQ ID NO: 114563 - DNA, 25 bp, mus musculus
aattctggatttgtcggggacatgc

SEQ ID NO: 114564 - DNA, 25 bp, mus musculus
gacatgcaattttacttctgtaagt

SEQ ID NO: 114565 - DNA, 25 bp, mus musculus
taagtgtgactgggtggtagatttt

SEQ ID NO: 114566 - DNA, 25 bp, mus musculus
tttacaatctatatcgttgagaatt

SEQ ID NO: 114567 - DNA, 25 bp, mus musculus
ggaacattccataccctgtcctggg

SEQ ID NO: 114568 - DNA, 25 bp, mus musculus
ttacaatctatatcgttgagaattc

SEQ ID NO: 114569 - DNA, 25 bp, mus musculus
ttccataccctgtcctgggccctag

SEQ ID NO: 114570 - DNA, 25 bp, mus musculus
cccaaaaagcacttatatctattat

SEQ ID NO: 114571 - DNA, 25 bp, mus musculus
gcgagcttccttgttttcaagtgtg

SEQ ID NO: 114572 - DNA, 25 bp, mus musculus
ttccttgttttcaagtgtgctgtgg

SEQ ID NO: 114573 - DNA, 25 bp, mus musculus
gttttcaagtgtgctgtggagttca

SEQ ID NO: 114574 - DNA, 25 bp, mus musculus
gagttcaaaatcgcttctggggatt

SEQ ID NO: 114575 - DNA, 25 bp, mus musculus
ttgagtcagactttctggctgtccc

SEQ ID NO: 114576 - DNA, 25 bp, mus musculus
aagaccttcagccagaggtcaacgc

SEQ ID NO: 114577 - DNA, 25 bp, mus musculus
accttcagccagaggtcaacgctga

SEQ ID NO: 114578 - DNA, 25 bp, mus musculus
ggcatagtcctgaggctcaggcagg

SEQ ID NO: 114579 - DNA, 25 bp, mus musculus
atagtcctgaggctcaggcaggctg

SEQ ID NO: 114580 - DNA, 25 bp, mus musculus
gtcctgaggctcaggcaggctgctg

SEQ ID NO: 114581 - DNA, 25 bp, mus musculus
ctcaggcaggctgctgcagaaaacc

SEQ ID NO: 114582 - DNA, 25 bp, mus musculus
gcagaaaacctgtcaggccagaatt

SEQ ID NO: 114583 - DNA, 25 bp, mus musculus
aacctgtcaggccagaattcttcag

SEQ ID NO: 114584 - DNA, 25 bp, mus musculus
ctgtcaggccagaattcttcagtga

SEQ ID NO: 114585 - DNA, 25 bp, mus musculus
atattatactgagggctggagagat

SEQ ID NO: 114586 - DNA, 25 bp, mus musculus
taatatccagctaaagagtacatat

SEQ ID NO: 114587 - DNA, 25 bp, mus musculus
tatgtatctcagtatgtgtatatta

SEQ ID NO: 114588 - DNA, 25 bp, mus musculus
ttcagccagaggtcaacgctgaggc

SEQ ID NO: 114589 - DNA, 25 bp, mus musculus
gtaaatagacatacccagctctgtt

SEQ ID NO: 114590 - DNA, 25 bp, mus musculus
aggtcaacgctgaggctgcacctga

SEQ ID NO: 114591 - DNA, 25 bp, mus musculus
tcaacgctgaggctgcacctgagaa

SEQ ID NO: 114592 - DNA, 25 bp, mus musculus
aggctgcacctgagaatccacacgg

SEQ ID NO: 114593 - DNA, 25 bp, mus musculus
ccttcagcaggaagtccgcctcagc

SEQ ID NO: 114594 - DNA, 25 bp, mus musculus
cagcgtccaccagagggttcacatg

SEQ ID NO: 114595 - DNA, 25 bp, mus musculus
cgtccaccagagggttcacatggca

SEQ ID NO: 114596 - DNA, 25 bp, mus musculus
tcacatggcatagtcctgaggctca

SEQ ID NO: 114597 - DNA, 25 bp, mus musculus
cagcagtgctgtggtactttagcca

SEQ ID NO: 114598 - DNA, 25 bp, mus musculus
tggtactttagccacaccagtgacg

SEQ ID NO: 114599 - DNA, 25 bp, mus musculus
acaccagtgacgtagtgtccccagc

SEQ ID NO: 114600 - DNA, 25 bp, mus musculus
acgtagtgtccccagcactgacact

SEQ ID NO: 114601 - DNA, 25 bp, mus musculus
tcatcacaggtgtgacaccagcccg

SEQ ID NO: 114602 - DNA, 25 bp, mus musculus
catcacaggtgtgacaccagcccgc

SEQ ID NO: 114603 - DNA, 25 bp, mus musculus
catcccctctgtgggagtagtgaac

SEQ ID NO: 114604 - DNA, 25 bp, mus musculus
gagtagtgaaccccattctcgccag

SEQ ID NO: 114605 - DNA, 25 bp, mus musculus
agtagtgaaccccattctcgccagc

SEQ ID NO: 114606 - DNA, 25 bp, mus musculus
cagcccgccaacgttgggtctgttg

SEQ ID NO: 114607 - DNA, 25 bp, mus musculus
tgggtctgttggagcccaagatgga

SEQ ID NO: 114608 - DNA, 25 bp, mus musculus
ggagctgtttcctgagtcagaacgg

SEQ ID NO: 114609 - DNA, 25 bp, mus musculus
ggtactttagccacaccagtgacgt

SEQ ID NO: 114610 - DNA, 25 bp, mus musculus
tactttagccacaccagtgacgtag

SEQ ID NO: 114611 - DNA, 25 bp, mus musculus
actttagccacaccagtgacgtagt

SEQ ID NO: 114612 - DNA, 25 bp, mus musculus
tttagccacaccagtgacgtagtgt

SEQ ID NO: 114613 - DNA, 25 bp, mus musculus
ttagccacaccagtgacgtagtgtc

SEQ ID NO: 114614 - DNA, 25 bp, mus musculus
agccacaccagtgacgtagtgtccc

SEQ ID NO: 114615 - DNA, 25 bp, mus musculus
gccacaccagtgacgtagtgtcccc

SEQ ID NO: 114616 - DNA, 25 bp, mus musculus
cacaccagtgacgtagtgtccccag

SEQ ID NO: 114617 - DNA, 25 bp, mus musculus
caccatggctgaaaccaccaagctc

SEQ ID NO: 114618 - DNA, 25 bp, mus musculus
catggctgaaaccaccaagctccag

SEQ ID NO: 114619 - DNA, 25 bp, mus musculus
ctactcctcaagggtgtgcgcttca

SEQ ID NO: 114620 - DNA, 25 bp, mus musculus
acactcaccacagtggacactcgaa

SEQ ID NO: 114621 - DNA, 25 bp, mus musculus
ctcaccacagtggacactcgaaggg

SEQ ID NO: 114622 - DNA, 25 bp, mus musculus
accacagtggacactcgaagggcat

SEQ ID NO: 114623 - DNA, 25 bp, mus musculus
aaggacttcgcaccaggctcacagc

SEQ ID NO: 114624 - DNA, 25 bp, mus musculus
ctgcccatcctgctgtacgatgagg

SEQ ID NO: 114625 - DNA, 25 bp, mus musculus
atcctgctgtacgatgaggatgtca

SEQ ID NO: 114626 - DNA, 25 bp, mus musculus
gtcaagacagacacactgcagatcg

SEQ ID NO: 114627 - DNA, 25 bp, mus musculus
aagacagacacactgcagatcgagg

SEQ ID NO: 114628 - DNA, 25 bp, mus musculus
acactgcagatcgaggagtttctgg

SEQ ID NO: 114629 - DNA, 25 bp, mus musculus
ggctgaaaccaccaagctccagctc

SEQ ID NO: 114630 - DNA, 25 bp, mus musculus
tgaaaccaccaagctccagctcttt

SEQ ID NO: 114631 - DNA, 25 bp, mus musculus
caccaagctccagctctttgtgaag

SEQ ID NO: 114632 - DNA, 25 bp, mus musculus
gtaggacactgcccttcctgtcagc

SEQ ID NO: 114633 - DNA, 25 bp, mus musculus
cagcggctcttcatggtcctactcc

SEQ ID NO: 114634 - DNA, 25 bp, mus musculus
ttcatggtcctactcctcaagggtg

SEQ ID NO: 114635 - DNA, 25 bp, mus musculus
atggtcctactcctcaagggtgtgc

SEQ ID NO: 114636 - DNA, 25 bp, mus musculus
gtcctactcctcaagggtgtgcgct

SEQ ID NO: 114637 - DNA, 25 bp, mus musculus
tgcgtgcataccacttttgttcttg

SEQ ID NO: 114638 - DNA, 25 bp, mus musculus
aaggctacctttgtattctctcctg

SEQ ID NO: 114639 - DNA, 25 bp, mus musculus
ttcttgcaaagtatcccttctgtaa

SEQ ID NO: 114640 - DNA, 25 bp, mus musculus
caatactgtgccctaaagtgtattt

SEQ ID NO: 114641 - DNA, 25 bp, mus musculus
ttattatggcacatcagcacgattt

SEQ ID NO: 114642 - DNA, 25 bp, mus musculus
tggcacatcagcacgatttctgttt

SEQ ID NO: 114643 - DNA, 25 bp, mus musculus
atcagcacgatttctgtttagataa

SEQ ID NO: 114644 - DNA, 25 bp, mus musculus
tagataatacaccactacattctgt

SEQ ID NO: 114645 - DNA, 25 bp, mus musculus
atacaccactacattctgttaataa

SEQ ID NO: 114646 - DNA, 25 bp, mus musculus
cactacattctgttaataatcagta

SEQ ID NO: 114647 - DNA, 25 bp, mus musculus
aaatctcaaatttctaaatctgcaa

SEQ ID NO: 114648 - DNA, 25 bp, mus musculus
caaatttctaaatctgcaagaataa

SEQ ID NO: 114649 - DNA, 25 bp, mus musculus
tctcctgtacctcttgagccttgaa

SEQ ID NO: 114650 - DNA, 25 bp, mus musculus
cttgagccttgaactttgacctctg

SEQ ID NO: 114651 - DNA, 25 bp, mus musculus
ccttgaactttgacctctgcagcaa

SEQ ID NO: 114652 - DNA, 25 bp, mus musculus
actttgacctctgcagcaataaagc

SEQ ID NO: 114653 - DNA, 25 bp, mus musculus
acctctgcagcaataaagcagcatt

SEQ ID NO: 114654 - DNA, 25 bp, mus musculus
cagcatttctacacatacaaggtca

SEQ ID NO: 114655 - DNA, 25 bp, mus musculus
ttctacacatacaaggtcatttttc

SEQ ID NO: 114656 - DNA, 25 bp, mus musculus
tacagttactctagtttgattaaat

SEQ ID NO: 114657 - DNA, 25 bp, mus musculus
agtcgccagcaaccatgccggacca

SEQ ID NO: 114658 - DNA, 25 bp, mus musculus
accatgccggaccaacaggctgagg

SEQ ID NO: 114659 - DNA, 25 bp, mus musculus
agagttcttggtcatgatggtgcgc

SEQ ID NO: 114660 - DNA, 25 bp, mus musculus
accaacaggctgaggccaggtccta

SEQ ID NO: 114661 - DNA, 25 bp, mus musculus
gttgggcaccgtgatgaggatgcta

SEQ ID NO: 114662 - DNA, 25 bp, mus musculus
ttgggcaccgtgatgaggatgctag

SEQ ID NO: 114663 - DNA, 25 bp, mus musculus
cagcggtactatcgactttgaagag

SEQ ID NO: 114664 - DNA, 25 bp, mus musculus
agcggtactatcgactttgaagagt

SEQ ID NO: 114665 - DNA, 25 bp, mus musculus
ggtactatcgactttgaagagttct

SEQ ID NO: 114666 - DNA, 25 bp, mus musculus
gtactatcgactttgaagagttctt

SEQ ID NO: 114667 - DNA, 25 bp, mus musculus
tactatcgactttgaagagttcttg

SEQ ID NO: 114668 - DNA, 25 bp, mus musculus
gtcccagtcgccagcaaccatgccg

SEQ ID NO: 114669 - DNA, 25 bp, mus musculus
tcccagtcgccagcaaccatgccgg

SEQ ID NO: 114670 - DNA, 25 bp, mus musculus
ttgggcaccgtgatgaggatgctag

SEQ ID NO: 114671 - DNA, 25 bp, mus musculus
cagcggtactatcgactttgaagag

SEQ ID NO: 114672 - DNA, 25 bp, mus musculus
agcggtactatcgactttgaagagt

SEQ ID NO: 114673 - DNA, 25 bp, mus musculus
ggtactatcgactttgaagagttct

SEQ ID NO: 114674 - DNA, 25 bp, mus musculus
gtactatcgactttgaagagttctt

SEQ ID NO: 114675 - DNA, 25 bp, mus musculus
tactatcgactttgaagagttcttg

SEQ ID NO: 114676 - DNA, 25 bp, mus musculus
agagttcttggtcatgatggtgcgc

SEQ ID NO: 114677 - DNA, 25 bp, mus musculus
cccagtcgccagcaaccatgccgga

SEQ ID NO: 114678 - DNA, 25 bp, mus musculus
ccagtcgccagcaaccatgccggac

SEQ ID NO: 114679 - DNA, 25 bp, mus musculus
cagtcgccagcaaccatgccggacc

SEQ ID NO: 114680 - DNA, 25 bp, mus musculus
agtcgccagcaaccatgccggacca

SEQ ID NO: 114681 - DNA, 25 bp, mus musculus
accatgccggaccaacaggctgagg

SEQ ID NO: 114682 - DNA, 25 bp, mus musculus
accaacaggctgaggccaggtccta

SEQ ID NO: 114683 - DNA, 25 bp, mus musculus
agagttgggcaccgtgatgaggatg

SEQ ID NO: 114684 - DNA, 25 bp, mus musculus
gttgggcaccgtgatgaggatgcta

SEQ ID NO: 114685 - DNA, 25 bp, mus musculus
gggaataactaagccccatgtcctg

SEQ ID NO: 114686 - DNA, 25 bp, mus musculus
aactaagccccatgtcctgaagagg

SEQ ID NO: 114687 - DNA, 25 bp, mus musculus
ttctaacactgtgccctggtggaga

SEQ ID NO: 114688 - DNA, 25 bp, mus musculus
taacactgtgccctggtggagaaag

SEQ ID NO: 114689 - DNA, 25 bp, mus musculus
tctgatgtgccttttgcacccttcc

SEQ ID NO: 114690 - DNA, 25 bp, mus musculus
ttcccattaggacaatcagtcccct

SEQ ID NO: 114691 - DNA, 25 bp, mus musculus
ttccttagcccttctcagtacccag

SEQ ID NO: 114692 - DNA, 25 bp, mus musculus
ccctcacggccatccaggctggttt

SEQ ID NO: 114693 - DNA, 25 bp, mus musculus
tcacggccatccaggctggttttgt

SEQ ID NO: 114694 - DNA, 25 bp, mus musculus
cggccatccaggctggttttgtaag

SEQ ID NO: 114695 - DNA, 25 bp, mus musculus
ccatccaggctggttttgtaagatg

SEQ ID NO: 114696 - DNA, 25 bp, mus musculus
caggcctggcattgttggttctatt

SEQ ID NO: 114697 - DNA, 25 bp, mus musculus
taagccccatgtcctgaagaggcag

SEQ ID NO: 114698 - DNA, 25 bp, mus musculus
gccccatgtcctgaagaggcaggcc

SEQ ID NO: 114699 - DNA, 25 bp, mus musculus
gacatcatctgtttcaaatggggtt

SEQ ID NO: 114700 - DNA, 25 bp, mus musculus
atcatctgtttcaaatggggttgtg

SEQ ID NO: 114701 - DNA, 25 bp, mus musculus
aagggcttatgggtcgctggctctc

SEQ ID NO: 114702 - DNA, 25 bp, mus musculus
ccaccaagccctttctaacactgtg

SEQ ID NO: 114703 - DNA, 25 bp, mus musculus
agccctttctaacactgtgccctgg

SEQ ID NO: 114704 - DNA, 25 bp, mus musculus
cctttctaacactgtgccctggtgg

SEQ ID NO: 114705 - DNA, 25 bp, mus musculus
agcgagaccagctgctgccaaacct

SEQ ID NO: 114706 - DNA, 25 bp, mus musculus
gagaccagctgctgccaaacctgag

SEQ ID NO: 114707 - DNA, 25 bp, mus musculus
ctgaaaagctggaccaccatcccga

SEQ ID NO: 114708 - DNA, 25 bp, mus musculus
acaaggtccatatcaccttgagcac

SEQ ID NO: 114709 - DNA, 25 bp, mus musculus
aggtccatatcaccttgagcaccca

SEQ ID NO: 114710 - DNA, 25 bp, mus musculus
tccatatcaccttgagcacccatga

SEQ ID NO: 114711 - DNA, 25 bp, mus musculus
tgagcacccatgaatgtgccggtct

SEQ ID NO: 114712 - DNA, 25 bp, mus musculus
atgaatgtgccggtctttcggaacg

SEQ ID NO: 114713 - DNA, 25 bp, mus musculus
acctggccagcttcatcgaacaagt

SEQ ID NO: 114714 - DNA, 25 bp, mus musculus
ccagcttcatcgaacaagtcgccgt

SEQ ID NO: 114715 - DNA, 25 bp, mus musculus
tcatcgaacaagtcgccgtgtctat

SEQ ID NO: 114716 - DNA, 25 bp, mus musculus
tcgaacaagtcgccgtgtctatgac

SEQ ID NO: 114717 - DNA, 25 bp, mus musculus
gagatgctatcttcaagcagttcca

SEQ ID NO: 114718 - DNA, 25 bp, mus musculus
tcgccgtgtctatgacatagatcta

SEQ ID NO: 114719 - DNA, 25 bp, mus musculus
atgctatcttcaagcagttccattt

SEQ ID NO: 114720 - DNA, 25 bp, mus musculus
ctatcttcaagcagttccattttaa

SEQ ID NO: 114721 - DNA, 25 bp, mus musculus
tcaagcagttccattttaaagactt

SEQ ID NO: 114722 - DNA, 25 bp, mus musculus
tcaacagggcttttggcttcatgac

SEQ ID NO: 114723 - DNA, 25 bp, mus musculus
caagagtagccctgcaggctgaaaa

SEQ ID NO: 114724 - DNA, 25 bp, mus musculus
gagtagccctgcaggctgaaaagct

SEQ ID NO: 114725 - DNA, 25 bp, mus musculus
tagccctgcaggctgaaaagctgga

SEQ ID NO: 114726 - DNA, 25 bp, mus musculus
gccagccagttctaccacaagagct

SEQ ID NO: 114727 - DNA, 25 bp, mus musculus
cagttctaccacaagagctgcaaga

SEQ ID NO: 114728 - DNA, 25 bp, mus musculus
tgtcctgtactgctaatgactgact

SEQ ID NO: 114729 - DNA, 25 bp, mus musculus
ctaatgactgactctccgtgtcagg

SEQ ID NO: 114730 - DNA, 25 bp, mus musculus
actgactctccgtgtcaggagtgct

SEQ ID NO: 114731 - DNA, 25 bp, mus musculus
tctccgtgtcaggagtgctccagtg

SEQ ID NO: 114732 - DNA, 25 bp, mus musculus
tgtcaggagtgctccagtgaataac

SEQ ID NO: 114733 - DNA, 25 bp, mus musculus
gaataactatgcactactttacatt

SEQ ID NO: 114734 - DNA, 25 bp, mus musculus
ctatgcactactttacatttcatgg

SEQ ID NO: 114735 - DNA, 25 bp, mus musculus
aaatcaattcctattctattgagtt

SEQ ID NO: 114736 - DNA, 25 bp, mus musculus
tttaatactgactagcaattctgaa

SEQ ID NO: 114737 - DNA, 25 bp, mus musculus
actgactagcaattctgaagtctta

SEQ ID NO: 114738 - DNA, 25 bp, mus musculus
taccacaagagctgcaagacggaga

SEQ ID NO: 114739 - DNA, 25 bp, mus musculus
aatggtctaaacccatagcattggt

SEQ ID NO: 114740 - DNA, 25 bp, mus musculus
ctaaacccatagcattggtcatggg

SEQ ID NO: 114741 - DNA, 25 bp, mus musculus
ccatagcattggtcatgggcaacct

SEQ ID NO: 114742 - DNA, 25 bp, mus musculus
cattggtcatgggcaacctaaactt

SEQ ID NO: 114743 - DNA, 25 bp, mus musculus
tcatgggcaacctaaacttttctca

SEQ ID NO: 114744 - DNA, 25 bp, mus musculus
taaacttttctcatgcaactaaaat

SEQ ID NO: 114745 - DNA, 25 bp, mus musculus
taagtgttttactgtcctgtactgc

SEQ ID NO: 114746 - DNA, 25 bp, mus musculus
agctaccaagagtccacaaagcagc

SEQ ID NO: 114747 - DNA, 25 bp, mus musculus
tccacaaagcagctcaccatgaaga

SEQ ID NO: 114748 - DNA, 25 bp, mus musculus
gccaaacttcggcggaagatcacca

SEQ ID NO: 114749 - DNA, 25 bp, mus musculus
cggaagatcaccacatatgtgtctt

SEQ ID NO: 114750 - DNA, 25 bp, mus musculus
tttcccctggaactggacatgacgc

SEQ ID NO: 114751 - DNA, 25 bp, mus musculus
ctggacatgacgcccttcatggcct

SEQ ID NO: 114752 - DNA, 25 bp, mus musculus
atgacgcccttcatggcctccagca

SEQ ID NO: 114753 - DNA, 25 bp, mus musculus
cccttcatggcctccagcaaagaga

SEQ ID NO: 114754 - DNA, 25 bp, mus musculus
atggcctccagcaaagagagcagga

SEQ ID NO: 114755 - DNA, 25 bp, mus musculus
gggcaataccagcagcccctggaca

SEQ ID NO: 114756 - DNA, 25 bp, mus musculus
ctggacagtctcaacaatgacaaca

SEQ ID NO: 114757 - DNA, 25 bp, mus musculus
agtctcaacaatgacaacaaatact

SEQ ID NO: 114758 - DNA, 25 bp, mus musculus
aagcagctcaccatgaagaagctgc

SEQ ID NO: 114759 - DNA, 25 bp, mus musculus
gacaacaaatactccctgtttgctg

SEQ ID NO: 114760 - DNA, 25 bp, mus musculus
aagctgcccattgtggcctgtttcc

SEQ ID NO: 114761 - DNA, 25 bp, mus musculus
cccattgtggcctgtttccatctca

SEQ ID NO: 114762 - DNA, 25 bp, mus musculus
gtggcctgtttccatctcaaacgat

SEQ ID NO: 114763 - DNA, 25 bp, mus musculus
tgtttccatctcaaacgatttgaac

SEQ ID NO: 114764 - DNA, 25 bp, mus musculus
catctcaaacgatttgaacactcag

SEQ ID NO: 114765 - DNA, 25 bp, mus musculus
tttgaacactcagccaaacttcggc

SEQ ID NO: 114766 - DNA, 25 bp, mus musculus
cactcagccaaacttcggcggaaga

SEQ ID NO: 114767 - DNA, 25 bp, mus musculus
actcaccatttaatccatatttcct

SEQ ID NO: 114768 - DNA, 25 bp, mus musculus
agggcttctgtgcagcccatggctg

SEQ ID NO: 114769 - DNA, 25 bp, mus musculus
catgcgactccaaacacactcaaag

SEQ ID NO: 114770 - DNA, 25 bp, mus musculus
actccaaacacactcaaagtttgcg

SEQ ID NO: 114771 - DNA, 25 bp, mus musculus
cagacaacgctcatcacctatagaa

SEQ ID NO: 114772 - DNA, 25 bp, mus musculus
acgctcatcacctatagaaatccag

SEQ ID NO: 114773 - DNA, 25 bp, mus musculus
ctcatcacctatagaaatccagccc

SEQ ID NO: 114774 - DNA, 25 bp, mus musculus
aatccagccctatagaagcaattca

SEQ ID NO: 114775 - DNA, 25 bp, mus musculus
ttttctggtcctagtgagtgcctcc

SEQ ID NO: 114776 - DNA, 25 bp, mus musculus
tctggtcctagtgagtgcctcccat

SEQ ID NO: 114777 - DNA, 25 bp, mus musculus
cctgaccagctctgccagtgtctgg

SEQ ID NO: 114778 - DNA, 25 bp, mus musculus
gaccagctctgccagtgtctggggt

SEQ ID NO: 114779 - DNA, 25 bp, mus musculus
aacatgtcaggctagtctgtctaga

SEQ ID NO: 114780 - DNA, 25 bp, mus musculus
tcaggctagtctgtctagaaggcca

SEQ ID NO: 114781 - DNA, 25 bp, mus musculus
tctgtctagaaggccactggccact

SEQ ID NO: 114782 - DNA, 25 bp, mus musculus
ccatgcctgtgggctgcccagacac

SEQ ID NO: 114783 - DNA, 25 bp, mus musculus
cagacacctcatataccaccaggca

SEQ ID NO: 114784 - DNA, 25 bp, mus musculus
acacctcatataccaccaggcagtg

SEQ ID NO: 114785 - DNA, 25 bp, mus musculus
ataccaccaggcagtggcagctccg

SEQ ID NO: 114786 - DNA, 25 bp, mus musculus
ctgctcagccatgcgactccaaaca

SEQ ID NO: 114787 - DNA, 25 bp, mus musculus
tctctcttctctctgcctgtcagca

SEQ ID NO: 114788 - DNA, 25 bp, mus musculus
ttctctctgcctgtcagcaaagtta

SEQ ID NO: 114789 - DNA, 25 bp, mus musculus
tcatcgtaatgctgtggatggctgg

SEQ ID NO: 114790 - DNA, 25 bp, mus musculus
acttcaatcaagtttttgcagcctg

SEQ ID NO: 114791 - DNA, 25 bp, mus musculus
atcaagtttttgcagcctgtctggg

SEQ ID NO: 114792 - DNA, 25 bp, mus musculus
cagcctgtctgggtctcctgtacat

SEQ ID NO: 114793 - DNA, 25 bp, mus musculus
gtctgggtctcctgtacatatacgc

SEQ ID NO: 114794 - DNA, 25 bp, mus musculus
gtctcctgtacatatacgcccgtca

SEQ ID NO: 114795 - DNA, 25 bp, mus musculus
tgtacatatacgcccgtcacaagta

SEQ ID NO: 114796 - DNA, 25 bp, mus musculus
acatatacgcccgtcacaagtattt

SEQ ID NO: 114797 - DNA, 25 bp, mus musculus
acaagtatttctggggctatgcgaa

SEQ ID NO: 114798 - DNA, 25 bp, mus musculus
atttctggggctatgcgaagccgct

SEQ ID NO: 114799 - DNA, 25 bp, mus musculus
tctctgcctgtcagcaaagttattt

SEQ ID NO: 114800 - DNA, 25 bp, mus musculus
ctgcctgtcagcaaagttatttcgc

SEQ ID NO: 114801 - DNA, 25 bp, mus musculus
cgggccctctggaattcgagagaat

SEQ ID NO: 114802 - DNA, 25 bp, mus musculus
tatttcgtgcacagcaaaactcttt

SEQ ID NO: 114803 - DNA, 25 bp, mus musculus
ttcgtgcacagcaaaactctttgga

SEQ ID NO: 114804 - DNA, 25 bp, mus musculus
gtgcacagcaaaactctttggagtt

SEQ ID NO: 114805 - DNA, 25 bp, mus musculus
tttatcctgtattcatcgtaatgct

SEQ ID NO: 114806 - DNA, 25 bp, mus musculus
ctgtattcatcgtaatgctgtggat

SEQ ID NO: 114807 - DNA, 25 bp, mus musculus
cgtactcgcctcgtcgagtcggctg

SEQ ID NO: 114808 - DNA, 25 bp, mus musculus
cgcctcgtcgagtcggctgggacgt

SEQ ID NO: 114809 - DNA, 25 bp, mus musculus
ggcgccacctcacgtggtaccctgg

SEQ ID NO: 114810 - DNA, 25 bp, mus musculus
gccacctcacgtggtaccctggaat

SEQ ID NO: 114811 - DNA, 25 bp, mus musculus
cgtggtaccctggaatgtgacactc

SEQ ID NO: 114812 - DNA, 25 bp, mus musculus
gaatgtgacactcttctcaatcctg

SEQ ID NO: 114813 - DNA, 25 bp, mus musculus
actcttctcaatcctggtggtcgca

SEQ ID NO: 114814 - DNA, 25 bp, mus musculus
cttctcaatcctggtggtcgcatca

SEQ ID NO: 114815 - DNA, 25 bp, mus musculus
ggtcgcatcaagtctggaacttgtg

SEQ ID NO: 114816 - DNA, 25 bp, mus musculus
aattcagctggtgaatgcgaccttt

SEQ ID NO: 114817 - DNA, 25 bp, mus musculus
ggtgaatgcgacctttggtgtgttg

SEQ ID NO: 114818 - DNA, 25 bp, mus musculus
gaatgcgacctttggtgtgttgtgt

SEQ ID NO: 114819 - DNA, 25 bp, mus musculus
aggctctgaacttggacccaaatgc

SEQ ID NO: 114820 - DNA, 25 bp, mus musculus
ctctgaacttggacccaaatgctta

SEQ ID NO: 114821 - DNA, 25 bp, mus musculus
tggacccaaatgcttaatagacaac

SEQ ID NO: 114822 - DNA, 25 bp, mus musculus
agaaggcgcttacttgcgaaatgac

SEQ ID NO: 114823 - DNA, 25 bp, mus musculus
cttgcgaaatgacactctttggaat

SEQ ID NO: 114824 - DNA, 25 bp, mus musculus
aaatgacactctttggaatttgtgt

SEQ ID NO: 114825 - DNA, 25 bp, mus musculus
tgacactctttggaatttgtgtgag

SEQ ID NO: 114826 - DNA, 25 bp, mus musculus
cactctttggaatttgtgtgaggcg

SEQ ID NO: 114827 - DNA, 25 bp, mus musculus
ctgactttggcctagctagaatcta

SEQ ID NO: 114828 - DNA, 25 bp, mus musculus
ctagaatctacagctaccagatggc

SEQ ID NO: 114829 - DNA, 25 bp, mus musculus
catacgcaacacccgtggacatgtg

SEQ ID NO: 114830 - DNA, 25 bp, mus musculus
caacacccgtggacatgtggagcgt

SEQ ID NO: 114831 - DNA, 25 bp, mus musculus
cagagatgttccgtcggaagcctct

SEQ ID NO: 114832 - DNA, 25 bp, mus musculus
tccgtcggaagcctctcttctgtgg

SEQ ID NO: 114833 - DNA, 25 bp, mus musculus
gtcggaagcctctcttctgtggaaa

SEQ ID NO: 114834 - DNA, 25 bp, mus musculus
ctctcttctgtggaaactctgaagc

SEQ ID NO: 114835 - DNA, 25 bp, mus musculus
gagcgcagctgctactggaaatgct

SEQ ID NO: 114836 - DNA, 25 bp, mus musculus
cgcagctgctactggaaatgctgac

SEQ ID NO: 114837 - DNA, 25 bp, mus musculus
agctgctactggaaatgctgacctt

SEQ ID NO: 114838 - DNA, 25 bp, mus musculus
ttaacccacataagcgaatctctgc

SEQ ID NO: 114839 - DNA, 25 bp, mus musculus
agatggccctcacgcctgtggtggt

SEQ ID NO: 114840 - DNA, 25 bp, mus musculus
tggccctcacgcctgtggtggttac

SEQ ID NO: 114841 - DNA, 25 bp, mus musculus
ccctcacgcctgtggtggttacgct

SEQ ID NO: 114842 - DNA, 25 bp, mus musculus
accgagctcctgaagttcttctgca

SEQ ID NO: 114843 - DNA, 25 bp, mus musculus
ctcctgaagttcttctgcagtctac

SEQ ID NO: 114844 - DNA, 25 bp, mus musculus
aagttcttctgcagtctacatacgc

SEQ ID NO: 114845 - DNA, 25 bp, mus musculus
ttcttctgcagtctacatacgcaac

SEQ ID NO: 114846 - DNA, 25 bp, mus musculus
ctacatacgcaacacccgtggacat

SEQ ID NO: 114847 - DNA, 25 bp, mus musculus
caggtctgctgtgatgggtcacatg

SEQ ID NO: 114848 - DNA, 25 bp, mus musculus
gtctgctgtgatgggtcacatgggc

SEQ ID NO: 114849 - DNA, 25 bp, mus musculus
gccctccaggtaggccctgagtctc

SEQ ID NO: 114850 - DNA, 25 bp, mus musculus
ctccaggtaggccctgagtctctct

SEQ ID NO: 114851 - DNA, 25 bp, mus musculus
gtaggccctgagtctctctgcttca

SEQ ID NO: 114852 - DNA, 25 bp, mus musculus
ggccctgagtctctctgcttcacca

SEQ ID NO: 114853 - DNA, 25 bp, mus musculus
agcctgctcccacttgtgtttggtg

SEQ ID NO: 114854 - DNA, 25 bp, mus musculus
ctgctcccacttgtgtttggtgatc

SEQ ID NO: 114855 - DNA, 25 bp, mus musculus
ccacttgtgtttggtgatcagcgcc

SEQ ID NO: 114856 - DNA, 25 bp, mus musculus
cttgtgtttggtgatcagcgccgcc

SEQ ID NO: 114857 - DNA, 25 bp, mus musculus
atccgagccgtcgtaggcgtactgc

SEQ ID NO: 114858 - DNA, 25 bp, mus musculus
gtcgtaggcgtactgctggtacccg

SEQ ID NO: 114859 - DNA, 25 bp, mus musculus
tgctgtgatgggtcacatgggcctt

SEQ ID NO: 114860 - DNA, 25 bp, mus musculus
tcacatgggcctttggggaatctgt

SEQ ID NO: 114861 - DNA, 25 bp, mus musculus
ctgtgcgcacagcgtcgcgttcccg

SEQ ID NO: 114862 - DNA, 25 bp, mus musculus
cagcgtcgcgttcccgttcttcagg

SEQ ID NO: 114863 - DNA, 25 bp, mus musculus
cgcgttcccgttcttcaggtatctg

SEQ ID NO: 114864 - DNA, 25 bp, mus musculus
cccgttcttcaggtatctgcggacg

SEQ ID NO: 114865 - DNA, 25 bp, mus musculus
gttcttcaggtatctgcggacgcac

SEQ ID NO: 114866 - DNA, 25 bp, mus musculus
cttcaggtatctgcggacgcactcc

SEQ ID NO: 114867 - DNA, 25 bp, mus musculus
tgatcggacttgggttgcgccgaag

SEQ ID NO: 114868 - DNA, 25 bp, mus musculus
tgggttgcgccgaaggacagccctg

SEQ ID NO: 114869 - DNA, 25 bp, mus musculus
tccccgacgcaaccatggctgaaga

SEQ ID NO: 114870 - DNA, 25 bp, mus musculus
ccccgacgcaaccatggctgaagaa

SEQ ID NO: 114871 - DNA, 25 bp, mus musculus
ccgacgcaaccatggctgaagaaca

SEQ ID NO: 114872 - DNA, 25 bp, mus musculus
cgacgcaaccatggctgaagaacaa

SEQ ID NO: 114873 - DNA, 25 bp, mus musculus
gacgcaaccatggctgaagaacaac

SEQ ID NO: 114874 - DNA, 25 bp, mus musculus
acgcaaccatggctgaagaacaacc

SEQ ID NO: 114875 - DNA, 25 bp, mus musculus
ctgaagaacaacctcaggtcgaact

SEQ ID NO: 114876 - DNA, 25 bp, mus musculus
tgaagaacaacctcaggtcgaactg

SEQ ID NO: 114877 - DNA, 25 bp, mus musculus
gaaggacagccctgagtctggagga

SEQ ID NO: 114878 - DNA, 25 bp, mus musculus
acagccctgagtctggaggagagaa

SEQ ID NO: 114879 - DNA, 25 bp, mus musculus
cagccctgagtctggaggagagaat

SEQ ID NO: 114880 - DNA, 25 bp, mus musculus
agccctgagtctggaggagagaatc

SEQ ID NO: 114881 - DNA, 25 bp, mus musculus
gccctgagtctggaggagagaatcc

SEQ ID NO: 114882 - DNA, 25 bp, mus musculus
ccctgagtctggaggagagaatccc

SEQ ID NO: 114883 - DNA, 25 bp, mus musculus
ggtccccgacgcaaccatggctgaa

SEQ ID NO: 114884 - DNA, 25 bp, mus musculus
gtccccgacgcaaccatggctgaag

SEQ ID NO: 114885 - DNA, 25 bp, mus musculus
aatacctggctcaagagtgctggac

SEQ ID NO: 114886 - DNA, 25 bp, mus musculus
gctggactaccagccacaccagcga

SEQ ID NO: 114887 - DNA, 25 bp, mus musculus
gccgtgcaggttctcactgagtcac

SEQ ID NO: 114888 - DNA, 25 bp, mus musculus
caggttctcactgagtcacactaac

SEQ ID NO: 114889 - DNA, 25 bp, mus musculus
gagtcacactaactcgggagcttgg

SEQ ID NO: 114890 - DNA, 25 bp, mus musculus
agcttggcctcacactaggctgtaa

SEQ ID NO: 114891 - DNA, 25 bp, mus musculus
gcctcacactaggctgtaaagagca

SEQ ID NO: 114892 - DNA, 25 bp, mus musculus
atgcgatgctgctaagctcaccgtg

SEQ ID NO: 114893 - DNA, 25 bp, mus musculus
tgctgctaagctcaccgtgtccaag

SEQ ID NO: 114894 - DNA, 25 bp, mus musculus
taagctcaccgtgtccaagcccagg

SEQ ID NO: 114895 - DNA, 25 bp, mus musculus
agagtgaacacacagccttagcatc

SEQ ID NO: 114896 - DNA, 25 bp, mus musculus
aacacacagccttagcatcgtgcca

SEQ ID NO: 114897 - DNA, 25 bp, mus musculus
gccacaccagcgagctccgggcaag

SEQ ID NO: 114898 - DNA, 25 bp, mus musculus
ccagcgagctccgggcaagaggacg

SEQ ID NO: 114899 - DNA, 25 bp, mus musculus
gctactgaatcggggactgtgagac

SEQ ID NO: 114900 - DNA, 25 bp, mus musculus
caccatcactctgctgttgatctgt

SEQ ID NO: 114901 - DNA, 25 bp, mus musculus
cactctgctgttgatctgtaaaacc

SEQ ID NO: 114902 - DNA, 25 bp, mus musculus
gtttcgcctctctacagaaactctt

SEQ ID NO: 114903 - DNA, 25 bp, mus musculus
tacagaaactcttccttgttgacac

SEQ ID NO: 114904 - DNA, 25 bp, mus musculus
ttgacacagttaaccaaggttcagg

SEQ ID NO: 114905 - DNA, 25 bp, mus musculus
ttgcgttctctgaagtcgcagactg

SEQ ID NO: 114906 - DNA, 25 bp, mus musculus
gcgttctctgaagtcgcagactgta

SEQ ID NO: 114907 - DNA, 25 bp, mus musculus
ggtattccttggattggataatgcc

SEQ ID NO: 114908 - DNA, 25 bp, mus musculus
caactttgctacacatgctgaaaga

SEQ ID NO: 114909 - DNA, 25 bp, mus musculus
atgacaggctcgggcagcacgtccc

SEQ ID NO: 114910 - DNA, 25 bp, mus musculus
gctacatcccacttcagaagagctt

SEQ ID NO: 114911 - DNA, 25 bp, mus musculus
agagcttactattgctggcatgacg

SEQ ID NO: 114912 - DNA, 25 bp, mus musculus
agcttactattgctggcatgacgtt

SEQ ID NO: 114913 - DNA, 25 bp, mus musculus
cttactattgctggcatgacgttta

SEQ ID NO: 114914 - DNA, 25 bp, mus musculus
tactattgctggcatgacgtttaca

SEQ ID NO: 114915 - DNA, 25 bp, mus musculus
ctattgctggcatgacgtttacaac

SEQ ID NO: 114916 - DNA, 25 bp, mus musculus
catgacgtttacaacttttgatctg

SEQ ID NO: 114917 - DNA, 25 bp, mus musculus
tctctgaagtcgcagactgtaagat

SEQ ID NO: 114918 - DNA, 25 bp, mus musculus
tctggatatgtccttcatatttgac

SEQ ID NO: 114919 - DNA, 25 bp, mus musculus
tggatatgtccttcatatttgactg

SEQ ID NO: 114920 - DNA, 25 bp, mus musculus
tatgtccttcatatttgactggatt

SEQ ID NO: 114921 - DNA, 25 bp, mus musculus
tgtccttcatatttgactggattta

SEQ ID NO: 114922 - DNA, 25 bp, mus musculus
tccttcatatttgactggatttaca

SEQ ID NO: 114923 - DNA, 25 bp, mus musculus
ttacagtggtttcagcagtgtgctg

SEQ ID NO: 114924 - DNA, 25 bp, mus musculus
ctggtattccttggattggataatg

SEQ ID NO: 114925 - DNA, 25 bp, mus musculus
ttgctctctatttttcgcaaatacg

SEQ ID NO: 114926 - DNA, 25 bp, mus musculus
tgctctctatttttcgcaaatacga

SEQ ID NO: 114927 - DNA, 25 bp, mus musculus
ctactcctgggcttggacaacgcgg

SEQ ID NO: 114928 - DNA, 25 bp, mus musculus
tactcctgggcttggacaacgcggg

SEQ ID NO: 114929 - DNA, 25 bp, mus musculus
ttgctgaagcaactcgcatctgaag

SEQ ID NO: 114930 - DNA, 25 bp, mus musculus
gatttaacatcaaaagcgtgcagtc

SEQ ID NO: 114931 - DNA, 25 bp, mus musculus
tttaacatcaaaagcgtgcagtcac

SEQ ID NO: 114932 - DNA, 25 bp, mus musculus
taacatcaaaagcgtgcagtcacaa

SEQ ID NO: 114933 - DNA, 25 bp, mus musculus
aggaaaatcagaccatactggagaa

SEQ ID NO: 114934 - DNA, 25 bp, mus musculus
aaatcagaccatactggagaagtta

SEQ ID NO: 114935 - DNA, 25 bp, mus musculus
aatcagaccatactggagaagttat

SEQ ID NO: 114936 - DNA, 25 bp, mus musculus
tcagaccatactggagaagttattt

SEQ ID NO: 114937 - DNA, 25 bp, mus musculus
gctctctatttttcgcaaatacgaa

SEQ ID NO: 114938 - DNA, 25 bp, mus musculus
aaagtggcaccagaccaggaggtgc

SEQ ID NO: 114939 - DNA, 25 bp, mus musculus
agtggcaccagaccaggaggtgcga

SEQ ID NO: 114940 - DNA, 25 bp, mus musculus
gtggcaccagaccaggaggtgcgaa

SEQ ID NO: 114941 - DNA, 25 bp, mus musculus
gcgaatcctactcctgggcttggac

SEQ ID NO: 114942 - DNA, 25 bp, mus musculus
cgaatcctactcctgggcttggaca

SEQ ID NO: 114943 - DNA, 25 bp, mus musculus
atcctactcctgggcttggacaacg

SEQ ID NO: 114944 - DNA, 25 bp, mus musculus
tcctactcctgggcttggacaacgc

SEQ ID NO: 114945 - DNA, 25 bp, mus musculus
ccaaggaccagactgtggtgtttgt

SEQ ID NO: 114946 - DNA, 25 bp, mus musculus
aggaccagactgtggtgtttgtagc

SEQ ID NO: 114947 - DNA, 25 bp, mus musculus
gttgcgcccacatctatagtgcctt

SEQ ID NO: 114948 - DNA, 25 bp, mus musculus
gcgcccacatctatagtgccttgga

SEQ ID NO: 114949 - DNA, 25 bp, mus musculus
gtgccttggaccagacggcccgcaa

SEQ ID NO: 114950 - DNA, 25 bp, mus musculus
tggaccagacggcccgcaagatcaa

SEQ ID NO: 114951 - DNA, 25 bp, mus musculus
accagacggcccgcaagatcaactt

SEQ ID NO: 114952 - DNA, 25 bp, mus musculus
agacggcccgcaagatcaacttggc

SEQ ID NO: 114953 - DNA, 25 bp, mus musculus
gcaagatcaacttggccaagttcac

SEQ ID NO: 114954 - DNA, 25 bp, mus musculus
agatcaacttggccaagttcacaca

SEQ ID NO: 114955 - DNA, 25 bp, mus musculus
ccaagttcacacacaacaaatgttc

SEQ ID NO: 114956 - DNA, 25 bp, mus musculus
tcacacacaacaaatgttccaccct

SEQ ID NO: 114957 - DNA, 25 bp, mus musculus
ttgtagccacaaagcaccatgcgga

SEQ ID NO: 114958 - DNA, 25 bp, mus musculus
tagccacaaagcaccatgcggagta

SEQ ID NO: 114959 - DNA, 25 bp, mus musculus
agcaccatgcggagtacctcacaga

SEQ ID NO: 114960 - DNA, 25 bp, mus musculus
accatgcggagtacctcacagagtt

SEQ ID NO: 114961 - DNA, 25 bp, mus musculus
atgcggagtacctcacagagttgct

SEQ ID NO: 114962 - DNA, 25 bp, mus musculus
agtacctcacagagttgctgatggg

SEQ ID NO: 114963 - DNA, 25 bp, mus musculus
acctcacagagttgctgatgggcca

SEQ ID NO: 114964 - DNA, 25 bp, mus musculus
tcacagagttgctgatgggccaggg

SEQ ID NO: 114965 - DNA, 25 bp, mus musculus
tctcagcctgatgctgatgcggtca

SEQ ID NO: 114966 - DNA, 25 bp, mus musculus
cacgcagtttcctttgccatacatg

SEQ ID NO: 114967 - DNA, 25 bp, mus musculus
agcagccccagagtgtgactttctg

SEQ ID NO: 114968 - DNA, 25 bp, mus musculus
cccagagtgtgactttctggtcctg

SEQ ID NO: 114969 - DNA, 25 bp, mus musculus
gtctccttggactttgtgccttgct

SEQ ID NO: 114970 - DNA, 25 bp, mus musculus
ttggactttgtgccttgctggagag

SEQ ID NO: 114971 - DNA, 25 bp, mus musculus
tctcaacctcagcagctctgaactg

SEQ ID NO: 114972 - DNA, 25 bp, mus musculus
tgaactgtggtgctctcgggcttct

SEQ ID NO: 114973 - DNA, 25 bp, mus musculus
ccccgagagtttggtgggcagcatt

SEQ ID NO: 114974 - DNA, 25 bp, mus musculus
tgttcaaaaaggcatcctttcagta

SEQ ID NO: 114975 - DNA, 25 bp, mus musculus
ttcagtaccctgtccctggttagtg

SEQ ID NO: 114976 - DNA, 25 bp, mus musculus
tcatcgtgtgtgagacacagcttca

SEQ ID NO: 114977 - DNA, 25 bp, mus musculus
gtttcctttgccatacatgctgtca

SEQ ID NO: 114978 - DNA, 25 bp, mus musculus
gctgtcactaacttaatgtgccatg

SEQ ID NO: 114979 - DNA, 25 bp, mus musculus
actaacttaatgtgccatgttacaa

SEQ ID NO: 114980 - DNA, 25 bp, mus musculus
tgccatgttacaacatctggagagg

SEQ ID NO: 114981 - DNA, 25 bp, mus musculus
ggcaagcaccctggtgacggacatc

SEQ ID NO: 114982 - DNA, 25 bp, mus musculus
caccctggtgacggacatcaccata

SEQ ID NO: 114983 - DNA, 25 bp, mus musculus
ggacatcaccatagcagccccagag

SEQ ID NO: 114984 - DNA, 25 bp, mus musculus
caccatagcagccccagagtgtgac

SEQ ID NO: 114985 - DNA, 25 bp, mus musculus
atttctgctcagggcagatcttctt

SEQ ID NO: 114986 - DNA, 25 bp, mus musculus
tttctgctcagggcagatcttcttc

SEQ ID NO: 114987 - DNA, 25 bp, mus musculus
gcctgaacttgaccgttgcctgagc

SEQ ID NO: 114988 - DNA, 25 bp, mus musculus
acttgaccgttgcctgagccctgaa

SEQ ID NO: 114989 - DNA, 25 bp, mus musculus
cttgaccgttgcctgagccctgaag

SEQ ID NO: 114990 - DNA, 25 bp, mus musculus
ttgaccgttgcctgagccctgaagg

SEQ ID NO: 114991 - DNA, 25 bp, mus musculus
gaccgttgcctgagccctgaaggtg

SEQ ID NO: 114992 - DNA, 25 bp, mus musculus
accgttgcctgagccctgaaggtgt

SEQ ID NO: 114993 - DNA, 25 bp, mus musculus
gcaacttcgcggtagttaaggagtg

SEQ ID NO: 114994 - DNA, 25 bp, mus musculus
ttaaggagtgcgtggacaggtacac

SEQ ID NO: 114995 - DNA, 25 bp, mus musculus
atagacaaagccaaatgctgtggaa

SEQ ID NO: 114996 - DNA, 25 bp, mus musculus
gacaaagccaaatgctgtggaaagg

SEQ ID NO: 114997 - DNA, 25 bp, mus musculus
tctgctcagggcagatcttcttcca

SEQ ID NO: 114998 - DNA, 25 bp, mus musculus
ctgctcagggcagatcttcttccaa

SEQ ID NO: 114999 - DNA, 25 bp, mus musculus
tgctcagggcagatcttcttccaac

SEQ ID NO: 115000 - DNA, 25 bp, mus musculus
cagggcagatcttcttccaacgtaa

SEQ ID NO: 115001 - DNA, 25 bp, mus musculus
ggcagatcttcttccaacgtaaacg

SEQ ID NO: 115002 - DNA, 25 bp, mus musculus
gcagatcttcttccaacgtaaacgg

SEQ ID NO: 115003 - DNA, 25 bp, mus musculus
gggcctgaacttgaccgttgcctga

SEQ ID NO: 115004 - DNA, 25 bp, mus musculus
ggcctgaacttgaccgttgcctgag

SEQ ID NO: 115005 - DNA, 25 bp, mus musculus
taactgtaaccacagagtcatttgt

SEQ ID NO: 115006 - DNA, 25 bp, mus musculus
taaccacagagtcatttgtagatat

SEQ ID NO: 115007 - DNA, 25 bp, mus musculus
tcatctgaacttttaccagtagact

SEQ ID NO: 115008 - DNA, 25 bp, mus musculus
tctgaacttttaccagtagactcta

SEQ ID NO: 115009 - DNA, 25 bp, mus musculus
gaacttttaccagtagactctatag

SEQ ID NO: 115010 - DNA, 25 bp, mus musculus
ttaccagtagactctatagagatca

SEQ ID NO: 115011 - DNA, 25 bp, mus musculus
atagagatcagccagcctaacacag

SEQ ID NO: 115012 - DNA, 25 bp, mus musculus
gagatcagccagcctaacacagatg

SEQ ID NO: 115013 - DNA, 25 bp, mus musculus
agccagcctaacacagatgtttact

SEQ ID NO: 115014 - DNA, 25 bp, mus musculus
cagcctaacacagatgtttacttga

SEQ ID NO: 115015 - DNA, 25 bp, mus musculus
tactcttattcccagatagcccatt

SEQ ID NO: 115016 - DNA, 25 bp, mus musculus
tattcccagatagcccattcaccca

SEQ ID NO: 115017 - DNA, 25 bp, mus musculus
acctatgtctttattgcacaaatga

SEQ ID NO: 115018 - DNA, 25 bp, mus musculus
attcccagatagcccattcacccaa

SEQ ID NO: 115019 - DNA, 25 bp, mus musculus
tatcactgtagcattctgaatccag

SEQ ID NO: 115020 - DNA, 25 bp, mus musculus
tgtagcattctgaatccagtgtggg

SEQ ID NO: 115021 - DNA, 25 bp, mus musculus
cctttcaatcgggctacactgctgt

SEQ ID NO: 115022 - DNA, 25 bp, mus musculus
aatcgggctacactgctgtcatctg

SEQ ID NO: 115023 - DNA, 25 bp, mus musculus
gctacactgctgtcatctgaacttt

SEQ ID NO: 115024 - DNA, 25 bp, mus musculus
acactgctgtcatctgaacttttac

SEQ ID NO: 115025 - DNA, 25 bp, mus musculus
ctgctgtcatctgaacttttaccag

SEQ ID NO: 115026 - DNA, 25 bp, mus musculus
cctccagtctctggagctctgcagg

SEQ ID NO: 115027 - DNA, 25 bp, mus musculus
tccagtctctggagctctgcagggc

SEQ ID NO: 115028 - DNA, 25 bp, mus musculus
tggggcaacttcttatgcagcctgt

SEQ ID NO: 115029 - DNA, 25 bp, mus musculus
atgcagcctgttcttgtggctcagg

SEQ ID NO: 115030 - DNA, 25 bp, mus musculus
gcagcctgttcttgtggctcagggg

SEQ ID NO: 115031 - DNA, 25 bp, mus musculus
agcctgttcttgtggctcaggggac

SEQ ID NO: 115032 - DNA, 25 bp, mus musculus
cctgttcttgtggctcaggggactc

SEQ ID NO: 115033 - DNA, 25 bp, mus musculus
ttcttgtggctcaggggactccagg

SEQ ID NO: 115034 - DNA, 25 bp, mus musculus
cttgtggctcaggggactccaggaa

SEQ ID NO: 115035 - DNA, 25 bp, mus musculus
tgtggctcaggggactccaggaatg

SEQ ID NO: 115036 - DNA, 25 bp, mus musculus
gactccaggaatggctcagggctca

SEQ ID NO: 115037 - DNA, 25 bp, mus musculus
gaatggctcagggctcatgcccagg

SEQ ID NO: 115038 - DNA, 25 bp, mus musculus
tgggtacaaacacttcattggccca

SEQ ID NO: 115039 - DNA, 25 bp, mus musculus
aatggctcagggctcatgcccaggt

SEQ ID NO: 115040 - DNA, 25 bp, mus musculus
ggtacaaacacttcattggcccaga

SEQ ID NO: 115041 - DNA, 25 bp, mus musculus
caaacacttcattggcccagatggt

SEQ ID NO: 115042 - DNA, 25 bp, mus musculus
aacacttcattggcccagatggtga

SEQ ID NO: 115043 - DNA, 25 bp, mus musculus
cacttcattggcccagatggtgagc

SEQ ID NO: 115044 - DNA, 25 bp, mus musculus
attggcccagatggtgagcggcctt

SEQ ID NO: 115045 - DNA, 25 bp, mus musculus
tggcccagatggtgagcggccttgt

SEQ ID NO: 115046 - DNA, 25 bp, mus musculus
tgagcggccttgtggggcaacttct

SEQ ID NO: 115047 - DNA, 25 bp, mus musculus
agatcctgtcctctctaccatttcc

SEQ ID NO: 115048 - DNA, 25 bp, mus musculus
tcctgtcctctctaccatttccaaa

SEQ ID NO: 115049 - DNA, 25 bp, mus musculus
gttacttttgggctgtatagcaatg

SEQ ID NO: 115050 - DNA, 25 bp, mus musculus
ttttgctttgtacagtctgactaat

SEQ ID NO: 115051 - DNA, 25 bp, mus musculus
tgctttgtacagtctgactaataac

SEQ ID NO: 115052 - DNA, 25 bp, mus musculus
gacccactatgtatagtatgtatat

SEQ ID NO: 115053 - DNA, 25 bp, mus musculus
agcttacagtagacctctaaaggag

SEQ ID NO: 115054 - DNA, 25 bp, mus musculus
cagtagacctctaaaggagacctgc

SEQ ID NO: 115055 - DNA, 25 bp, mus musculus
acctctaaaggagacctgcatttgc

SEQ ID NO: 115056 - DNA, 25 bp, mus musculus
gacctgcatttgctaactcatggaa

SEQ ID NO: 115057 - DNA, 25 bp, mus musculus
catttgctaactcatggaaatacag

SEQ ID NO: 115058 - DNA, 25 bp, mus musculus
ggcagaaaacatcccgtgccaaaag

SEQ ID NO: 115059 - DNA, 25 bp, mus musculus
tgtcctctctaccatttccaaaagt

SEQ ID NO: 115060 - DNA, 25 bp, mus musculus
taccatttccaaaagtgcaacgacg

SEQ ID NO: 115061 - DNA, 25 bp, mus musculus
catttccaaaagtgcaacgacgcca

SEQ ID NO: 115062 - DNA, 25 bp, mus musculus
tgcaacgacgccagaaccgaacaag

SEQ ID NO: 115063 - DNA, 25 bp, mus musculus
gacgccagaaccgaacaagaagcca

SEQ ID NO: 115064 - DNA, 25 bp, mus musculus
agagaacaagccagctgaagccaag

SEQ ID NO: 115065 - DNA, 25 bp, mus musculus
gaacaagccagctgaagccaagaaa

SEQ ID NO: 115066 - DNA, 25 bp, mus musculus
caagccagctgaagccaagaaaacc

SEQ ID NO: 115067 - DNA, 25 bp, mus musculus
ctcgtgcgaatcggcaagtgccagt

SEQ ID NO: 115068 - DNA, 25 bp, mus musculus
tcgtgcgaatcggcaagtgccagtg

SEQ ID NO: 115069 - DNA, 25 bp, mus musculus
tgaagactcgtgtcagccgggagga

SEQ ID NO: 115070 - DNA, 25 bp, mus musculus
agtgctgtgcttccggcaacatcaa

SEQ ID NO: 115071 - DNA, 25 bp, mus musculus
gctgtgcttccggcaacatcaacac

SEQ ID NO: 115072 - DNA, 25 bp, mus musculus
gtgcttccggcaacatcaacaccgc

SEQ ID NO: 115073 - DNA, 25 bp, mus musculus
ttccggcaacatcaacaccgcctgg

SEQ ID NO: 115074 - DNA, 25 bp, mus musculus
gcaacatcaacaccgcctggtccaa

SEQ ID NO: 115075 - DNA, 25 bp, mus musculus
ccacccaggcaataaaatcagcctg

SEQ ID NO: 115076 - DNA, 25 bp, mus musculus
gcaataaaatcagcctgctagggtt

SEQ ID NO: 115077 - DNA, 25 bp, mus musculus
caataaaatcagcctgctagggttc

SEQ ID NO: 115078 - DNA, 25 bp, mus musculus
tcagcctgctagggttcctgggcct

SEQ ID NO: 115079 - DNA, 25 bp, mus musculus
cgaatcggcaagtgccagtgcgttc

SEQ ID NO: 115080 - DNA, 25 bp, mus musculus
tcggcaagtgccagtgcgttctggg

SEQ ID NO: 115081 - DNA, 25 bp, mus musculus
gcaagtgccagtgcgttctggggca

SEQ ID NO: 115082 - DNA, 25 bp, mus musculus
gttctggggcactgtggccgctgct

SEQ ID NO: 115083 - DNA, 25 bp, mus musculus
ttctggggcactgtggccgctgctt

SEQ ID NO: 115084 - DNA, 25 bp, mus musculus
cgctgctttggggagccctggtctg

SEQ ID NO: 115085 - DNA, 25 bp, mus musculus
tgctttggggagccctggtctggac

SEQ ID NO: 115086 - DNA, 25 bp, mus musculus
gctccagcagggcagagaggccacc

SEQ ID NO: 115087 - DNA, 25 bp, mus musculus
tttggtgtcaccactgttctcacca

SEQ ID NO: 115088 - DNA, 25 bp, mus musculus
gtggcatacgcgacggccatggact

SEQ ID NO: 115089 - DNA, 25 bp, mus musculus
gctgagaccaagacctacaacagtg

SEQ ID NO: 115090 - DNA, 25 bp, mus musculus
atttcccgcatcatcttccctgtgc

SEQ ID NO: 115091 - DNA, 25 bp, mus musculus
atcttccctgtgctctttgccatat

SEQ ID NO: 115092 - DNA, 25 bp, mus musculus
cctgtgctctttgccatattcaatc

SEQ ID NO: 115093 - DNA, 25 bp, mus musculus
ctctttgccatattcaatcttgtct

SEQ ID NO: 115094 - DNA, 25 bp, mus musculus
gccatattcaatcttgtctattggg

SEQ ID NO: 115095 - DNA, 25 bp, mus musculus
ttcaatcttgtctattgggctacat

SEQ ID NO: 115096 - DNA, 25 bp, mus musculus
cttgtctattgggctacatatgtga

SEQ ID NO: 115097 - DNA, 25 bp, mus musculus
atgatccgcaaacagtagataatag

SEQ ID NO: 115098 - DNA, 25 bp, mus musculus
gtggcagcacagcttccagagcact

SEQ ID NO: 115099 - DNA, 25 bp, mus musculus
tggttcatagccgtctgttatgcct

SEQ ID NO: 115100 - DNA, 25 bp, mus musculus
gcacagcttccagagcactgtatac

SEQ ID NO: 115101 - DNA, 25 bp, mus musculus
ttttcagcactgattgaatttgcta

SEQ ID NO: 115102 - DNA, 25 bp, mus musculus
gtaccagaggccctggagatgaaga

SEQ ID NO: 115103 - DNA, 25 bp, mus musculus
accacctatcctatcaatctggcca

SEQ ID NO: 115104 - DNA, 25 bp, mus musculus
accatctccaagtctgctgctgctc

SEQ ID NO: 115105 - DNA, 25 bp, mus musculus
tccaagtctgctgctgctcccagtg

SEQ ID NO: 115106 - DNA, 25 bp, mus musculus
gcttcttcaactccaacagcgattg

SEQ ID NO: 115107 - DNA, 25 bp, mus musculus
tcaactccaacagcgattgcttcac

SEQ ID NO: 115108 - DNA, 25 bp, mus musculus
aaagttctgcttgacaagtccccat

SEQ ID NO: 115109 - DNA, 25 bp, mus musculus
ctgcttgacaagtccccatcgttga

SEQ ID NO: 115110 - DNA, 25 bp, mus musculus
tgactaggcagctaaccagtgtcac

SEQ ID NO: 115111 - DNA, 25 bp, mus musculus
ctaggcagctaaccagtgtcacctt

SEQ ID NO: 115112 - DNA, 25 bp, mus musculus
tttcaggtactactttctaattcat

SEQ ID NO: 115113 - DNA, 25 bp, mus musculus
ctttctaattcatggtagaatggct

SEQ ID NO: 115114 - DNA, 25 bp, mus musculus
taagtaattttctctacatggtact

SEQ ID NO: 115115 - DNA, 25 bp, mus musculus
gtaattttctctacatggtactgta

SEQ ID NO: 115116 - DNA, 25 bp, mus musculus
ttctctacatggtactgtacggtac

SEQ ID NO: 115117 - DNA, 25 bp, mus musculus
cctgtttcttcattggggtcttgtg

SEQ ID NO: 115118 - DNA, 25 bp, mus musculus
tcttcattggggtcttgtgtaatga

SEQ ID NO: 115119 - DNA, 25 bp, mus musculus
tcattggggtcttgtgtaatgacta

SEQ ID NO: 115120 - DNA, 25 bp, mus musculus
gacaagtccccatcgttgaagtgac

SEQ ID NO: 115121 - DNA, 25 bp, mus musculus
tccccatcgttgaagtgactggaat

SEQ ID NO: 115122 - DNA, 25 bp, mus musculus
tggtcccatgatgtgtatgtaaata

SEQ ID NO: 115123 - DNA, 25 bp, mus musculus
agagtagcagcactccatatgcagg

SEQ ID NO: 115124 - DNA, 25 bp, mus musculus
gtagcagcactccatatgcaggtca

SEQ ID NO: 115125 - DNA, 25 bp, mus musculus
gcactccatatgcaggtcagaacgt

SEQ ID NO: 115126 - DNA, 25 bp, mus musculus
gttgcttggactgactgttgtaact

SEQ ID NO: 115127 - DNA, 25 bp, mus musculus
tgtaacttaatgcttcttagaaaag

SEQ ID NO: 115128 - DNA, 25 bp, mus musculus
tctcagctgctggggtcagtcagga

SEQ ID NO: 115129 - DNA, 25 bp, mus musculus
tcatgggttcctataggtctgtgga

SEQ ID NO: 115130 - DNA, 25 bp, mus musculus
cggcgtacaccatgtgacggcagtg

SEQ ID NO: 115131 - DNA, 25 bp, mus musculus
ttgccacaaactcctggaggccctc

SEQ ID NO: 115132 - DNA, 25 bp, mus musculus
tttactcaactttgctctaaagacg

SEQ ID NO: 115133 - DNA, 25 bp, mus musculus
tgctctaaagacgagcctgcacttc

SEQ ID NO: 115134 - DNA, 25 bp, mus musculus
gagcctgcacttcttgtagatggaa

SEQ ID NO: 115135 - DNA, 25 bp, mus musculus
gtcatagctgctgactgagtgagct

SEQ ID NO: 115136 - DNA, 25 bp, mus musculus
tgctgggctgagctgtgagtttaga

SEQ ID NO: 115137 - DNA, 25 bp, mus musculus
gtctgatttctagctttctctgtgg

SEQ ID NO: 115138 - DNA, 25 bp, mus musculus
tttctagctttctctgtggatcaag

SEQ ID NO: 115139 - DNA, 25 bp, mus musculus
gctttctctgtggatcaagatcaga

SEQ ID NO: 115140 - DNA, 25 bp, mus musculus
gttcctataggtctgtggaagtgga

SEQ ID NO: 115141 - DNA, 25 bp, mus musculus
gaatccgttccagactcaaacccat

SEQ ID NO: 115142 - DNA, 25 bp, mus musculus
gactcaaacccatcgatgcagacac

SEQ ID NO: 115143 - DNA, 25 bp, mus musculus
aacccatcgatgcagacaccatcga

SEQ ID NO: 115144 - DNA, 25 bp, mus musculus
cagacaccatcgacatctatgcccg

SEQ ID NO: 115145 - DNA, 25 bp, mus musculus
tcttcccggcagcttttgcagcggt

SEQ ID NO: 115146 - DNA, 25 bp, mus musculus
cttttgcagcggtcaacatcatcta

SEQ ID NO: 115147 - DNA, 25 bp, mus musculus
cagcggtcaacatcatctactgggc

SEQ ID NO: 115148 - DNA, 25 bp, mus musculus
taaatactctgcacttgttaggaac

SEQ ID NO: 115149 - DNA, 25 bp, mus musculus
aatactctgcacttgttaggaacac

SEQ ID NO: 115150 - DNA, 25 bp, mus musculus
tccttctttgagccagacgccaact

SEQ ID NO: 115151 - DNA, 25 bp, mus musculus
cttctttgagccagacgccaacttg

SEQ ID NO: 115152 - DNA, 25 bp, mus musculus
tctttgagccagacgccaacttgac

SEQ ID NO: 115153 - DNA, 25 bp, mus musculus
tttgagccagacgccaacttgaccc

SEQ ID NO: 115154 - DNA, 25 bp, mus musculus
tgagccagacgccaacttgaccctc

SEQ ID NO: 115155 - DNA, 25 bp, mus musculus
cattaatcaggagcgcgctcagcaa

SEQ ID NO: 115156 - DNA, 25 bp, mus musculus
ttaatcaggagcgcgctcagcaagc

SEQ ID NO: 115157 - DNA, 25 bp, mus musculus
aatcaggagcgcgctcagcaagctt

SEQ ID NO: 115158 - DNA, 25 bp, mus musculus
gagcgcgctcagcaagcttggtagt

SEQ ID NO: 115159 - DNA, 25 bp, mus musculus
gcgcgctcagcaagcttggtagttt

SEQ ID NO: 115160 - DNA, 25 bp, mus musculus
tactctgcacttgttaggaacacgc

SEQ ID NO: 115161 - DNA, 25 bp, mus musculus
ctctgcacttgttaggaacacgcat

SEQ ID NO: 115162 - DNA, 25 bp, mus musculus
taggaacacgcatatcccttctttg

SEQ ID NO: 115163 - DNA, 25 bp, mus musculus
ggaacacgcatatcccttctttgtt

SEQ ID NO: 115164 - DNA, 25 bp, mus musculus
aacacgcatatcccttctttgttga

SEQ ID NO: 115165 - DNA, 25 bp, mus musculus
cacgcatatcccttctttgttgagt

SEQ ID NO: 115166 - DNA, 25 bp, mus musculus
cgcatatcccttctttgttgagttt

SEQ ID NO: 115167 - DNA, 25 bp, mus musculus
ggtccttctttgagccagacgccaa

SEQ ID NO: 115168 - DNA, 25 bp, mus musculus
ccgccttttgcttgttcaatcttgt

SEQ ID NO: 115169 - DNA, 25 bp, mus musculus
tgttcaatcttgtttactgggtctc

SEQ ID NO: 115170 - DNA, 25 bp, mus musculus
tcatactatccatgcccaatccgtg

SEQ ID NO: 115171 - DNA, 25 bp, mus musculus
tgcccaatccgtggttattgtaatt

SEQ ID NO: 115172 - DNA, 25 bp, mus musculus
ttgaatttcagcgtgcactgtcctt

SEQ ID NO: 115173 - DNA, 25 bp, mus musculus
ttcagcgtgcactgtccttcaaacc

SEQ ID NO: 115174 - DNA, 25 bp, mus musculus
gtgcactgtccttcaaacctgcaag

SEQ ID NO: 115175 - DNA, 25 bp, mus musculus
tcaaacctgcaaggcaaagtaaagt

SEQ ID NO: 115176 - DNA, 25 bp, mus musculus
ctgttacactgagcaagataccttt

SEQ ID NO: 115177 - DNA, 25 bp, mus musculus
tgtgtactatgttcacttgggatca

SEQ ID NO: 115178 - DNA, 25 bp, mus musculus
ctatgttcacttgggatcaagttgt

SEQ ID NO: 115179 - DNA, 25 bp, mus musculus
acctcccgtatctgtgaagaatcac

SEQ ID NO: 115180 - DNA, 25 bp, mus musculus
atcttgtttactgggtctcctatct

SEQ ID NO: 115181 - DNA, 25 bp, mus musculus
gggtctcctatctttatctgtaaag

SEQ ID NO: 115182 - DNA, 25 bp, mus musculus
gtgttattcgctgaatcttatggag

SEQ ID NO: 115183 - DNA, 25 bp, mus musculus
gacaaaatgcactttctaagtccaa

SEQ ID NO: 115184 - DNA, 25 bp, mus musculus
atgcactttctaagtccaacgatat

SEQ ID NO: 115185 - DNA, 25 bp, mus musculus
agtccaacgatataatcccctatgt

SEQ ID NO: 115186 - DNA, 25 bp, mus musculus
cctatgtggtcaccgaatgtgtttc

SEQ ID NO: 115187 - DNA, 25 bp, mus musculus
ctctgtctcaacgtagtaatacata

SEQ ID NO: 115188 - DNA, 25 bp, mus musculus
gaagcgtcttcgaagactcatcaca

SEQ ID NO: 115189 - DNA, 25 bp, mus musculus
tcttcgaagactcatcacaccagac

SEQ ID NO: 115190 - DNA, 25 bp, mus musculus
ctgggagccactcttctgttcagct

SEQ ID NO: 115191 - DNA, 25 bp, mus musculus
agcttgtcacctctcagtcctttcc

SEQ ID NO: 115192 - DNA, 25 bp, mus musculus
cctttccaagtgagctctaggaagc

SEQ ID NO: 115193 - DNA, 25 bp, mus musculus
ttgaactcaacatcttgactttctg

SEQ ID NO: 115194 - DNA, 25 bp, mus musculus
attttcaaggtcacacagcctgtca

SEQ ID NO: 115195 - DNA, 25 bp, mus musculus
aaggtcacacagcctgtcagagccc

SEQ ID NO: 115196 - DNA, 25 bp, mus musculus
cctgtcagagccctagaccttcctt

SEQ ID NO: 115197 - DNA, 25 bp, mus musculus
ctagaccttccttgaacttgctgct

SEQ ID NO: 115198 - DNA, 25 bp, mus musculus
tgcagcagctaacaagcctgcatgg

SEQ ID NO: 115199 - DNA, 25 bp, mus musculus
agctaacaagcctgcatggatcacc

SEQ ID NO: 115200 - DNA, 25 bp, mus musculus
accacaggatggctcctctgctcaa

SEQ ID NO: 115201 - DNA, 25 bp, mus musculus
aagcctgcatggatcacctgctgtg

SEQ ID NO: 115202 - DNA, 25 bp, mus musculus
tgctcaaaactgttcgtcctctcca

SEQ ID NO: 115203 - DNA, 25 bp, mus musculus
acaagaactcattgcctgggagaag

SEQ ID NO: 115204 - DNA, 25 bp, mus musculus
actcattgcctgggagaaggagact

SEQ ID NO: 115205 - DNA, 25 bp, mus musculus
actccagagccaggaacctggtcaa

SEQ ID NO: 115206 - DNA, 25 bp, mus musculus
gagccaggaacctggtcaaggctag

SEQ ID NO: 115207 - DNA, 25 bp, mus musculus
cctgccagtcttctgggagccactc

SEQ ID NO: 115208 - DNA, 25 bp, mus musculus
agtcttctgggagccactcttctgt

SEQ ID NO: 115209 - DNA, 25 bp, mus musculus
ggctacctgggcactaggtgcgagt

SEQ ID NO: 115210 - DNA, 25 bp, mus musculus
gaaccagagcgggtaccagaacctg

SEQ ID NO: 115211 - DNA, 25 bp, mus musculus
gtgtgacagcttttcctgtgccaga

SEQ ID NO: 115212 - DNA, 25 bp, mus musculus
gtgacagcttttcctgtgccagaaa

SEQ ID NO: 115213 - DNA, 25 bp, mus musculus
gacagcttttcctgtgccagaaaca

SEQ ID NO: 115214 - DNA, 25 bp, mus musculus
cagcttttcctgtgccagaaacaag

SEQ ID NO: 115215 - DNA, 25 bp, mus musculus
ttttcctgtgccagaaacaagggcg

SEQ ID NO: 115216 - DNA, 25 bp, mus musculus
cctatgctcaggccatggagagtgt

SEQ ID NO: 115217 - DNA, 25 bp, mus musculus
tgctcaggccatggagagtgtcact

SEQ ID NO: 115218 - DNA, 25 bp, mus musculus
atgcaaatgccacgcaggttacatt

SEQ ID NO: 115219 - DNA, 25 bp, mus musculus
gcaaatgccacgcaggttacattgg

SEQ ID NO: 115220 - DNA, 25 bp, mus musculus
aaatgccacgcaggttacattgggg

SEQ ID NO: 115221 - DNA, 25 bp, mus musculus
gtaccagaacctgtgccgggacagg

SEQ ID NO: 115222 - DNA, 25 bp, mus musculus
atgccacgcaggttacattggggac

SEQ ID NO: 115223 - DNA, 25 bp, mus musculus
gagtgtagctgcaaccagtgctact

SEQ ID NO: 115224 - DNA, 25 bp, mus musculus
gtgtagctgcaaccagtgctactcg

SEQ ID NO: 115225 - DNA, 25 bp, mus musculus
gtagctgcaaccagtgctactcgct

SEQ ID NO: 115226 - DNA, 25 bp, mus musculus
gcaaccagtgctactcgctacgaga

SEQ ID NO: 115227 - DNA, 25 bp, mus musculus
aaccagtgctactcgctacgagagt

SEQ ID NO: 115228 - DNA, 25 bp, mus musculus
actcgctacgagagtgatgttcggg

SEQ ID NO: 115229 - DNA, 25 bp, mus musculus
atctacggacctttctgcgagtgtg

SEQ ID NO: 115230 - DNA, 25 bp, mus musculus
aagccctttaggatgagggcaggag

SEQ ID NO: 115231 - DNA, 25 bp, mus musculus
ggtctccttcttgctgctcggtgtt

SEQ ID NO: 115232 - DNA, 25 bp, mus musculus
tcagtttttgccagagggaagaaga

SEQ ID NO: 115233 - DNA, 25 bp, mus musculus
ttattctcagaacaccaagtaaatt

SEQ ID NO: 115234 - DNA, 25 bp, mus musculus
aatatatgcctattcagactatata

SEQ ID NO: 115235 - DNA, 25 bp, mus musculus
atatgcctattcagactatatacag

SEQ ID NO: 115236 - DNA, 25 bp, mus musculus
tgcctattcagactatatacagagc

SEQ ID NO: 115237 - DNA, 25 bp, mus musculus
aattatctgttctatggaccaaatg

SEQ ID NO: 115238 - DNA, 25 bp, mus musculus
tatctgttctatggaccaaatgtaa

SEQ ID NO: 115239 - DNA, 25 bp, mus musculus
ggaatcacagctagaacacgggcgt

SEQ ID NO: 115240 - DNA, 25 bp, mus musculus
atcacagctagaacacgggcgtcat

SEQ ID NO: 115241 - DNA, 25 bp, mus musculus
acagctagaacacgggcgtcatgta

SEQ ID NO: 115242 - DNA, 25 bp, mus musculus
ctccttcttgctgctcggtgttctt

SEQ ID NO: 115243 - DNA, 25 bp, mus musculus
gctcggtgttctttgatgtgaaact

SEQ ID NO: 115244 - DNA, 25 bp, mus musculus
tgtttgtaagcacctctgagatgtt

SEQ ID NO: 115245 - DNA, 25 bp, mus musculus
taagcacctctgagatgtttggcaa

SEQ ID NO: 115246 - DNA, 25 bp, mus musculus
gcacctctgagatgtttggcaagaa

SEQ ID NO: 115247 - DNA, 25 bp, mus musculus
cctctgagatgtttggcaagaaatc

SEQ ID NO: 115248 - DNA, 25 bp, mus musculus
ttggcaagaaatcccctgatttcca

SEQ ID NO: 115249 - DNA, 25 bp, mus musculus
taccttatagagcacaacgttaaag

SEQ ID NO: 115250 - DNA, 25 bp, mus musculus
aggcctcagttctcagtgactatgg

SEQ ID NO: 115251 - DNA, 25 bp, mus musculus
gaccccagcaagcaggacatcctgg

SEQ ID NO: 115252 - DNA, 25 bp, mus musculus
tgtttctctgcattgactgctctgg

SEQ ID NO: 115253 - DNA, 25 bp, mus musculus
ttctctgcattgactgctctggatc

SEQ ID NO: 115254 - DNA, 25 bp, mus musculus
tctgcattgactgctctggatcaca

SEQ ID NO: 115255 - DNA, 25 bp, mus musculus
ttgactgctctggatcacaccggtc

SEQ ID NO: 115256 - DNA, 25 bp, mus musculus
actgctctggatcacaccggtcgct

SEQ ID NO: 115257 - DNA, 25 bp, mus musculus
tgagttttattcggtccacagagct

SEQ ID NO: 115258 - DNA, 25 bp, mus musculus
ttcggtccacagagctggattcaaa

SEQ ID NO: 115259 - DNA, 25 bp, mus musculus
actggtcgtggttccagcttcgatg

SEQ ID NO: 115260 - DNA, 25 bp, mus musculus
cgtggttccagcttcgatgcatgca

SEQ ID NO: 115261 - DNA, 25 bp, mus musculus
agcttcgatgcatgcaagttggagg

SEQ ID NO: 115262 - DNA, 25 bp, mus musculus
cccagcaagcaggacatcctggcca

SEQ ID NO: 115263 - DNA, 25 bp, mus musculus
caggacatcctggccatcttcaagc

SEQ ID NO: 115264 - DNA, 25 bp, mus musculus
gacatcctggccatcttcaagcgcc

SEQ ID NO: 115265 - DNA, 25 bp, mus musculus
ctggccatcttcaagcgcctgcgtc

SEQ ID NO: 115266 - DNA, 25 bp, mus musculus
atcttcaagcgcctgcgtcggtgcc

SEQ ID NO: 115267 - DNA, 25 bp, mus musculus
tgtgttttgactgtggtgccaaaaa

SEQ ID NO: 115268 - DNA, 25 bp, mus musculus
atcccagctgggccagcataagcta

SEQ ID NO: 115269 - DNA, 25 bp, mus musculus
ccagcataagctatggggtgtttct

SEQ ID NO: 115270 - DNA, 25 bp, mus musculus
cgccaaaccttagacctcatcattg

SEQ ID NO: 115271 - DNA, 25 bp, mus musculus
ttagacctcatcattggcatcttct

SEQ ID NO: 115272 - DNA, 25 bp, mus musculus
gacctttggcttgcactcgactatg

SEQ ID NO: 115273 - DNA, 25 bp, mus musculus
cttgcactcgactatgtagccagca

SEQ ID NO: 115274 - DNA, 25 bp, mus musculus
gtcatgaaccttctggtgattagct

SEQ ID NO: 115275 - DNA, 25 bp, mus musculus
atgaaccttctggtgattagctttg

SEQ ID NO: 115276 - DNA, 25 bp, mus musculus
gatcgttacttttccatcacaagac

SEQ ID NO: 115277 - DNA, 25 bp, mus musculus
ttttccatcacaagaccactgacat

SEQ ID NO: 115278 - DNA, 25 bp, mus musculus
atcacaagaccactgacataccgag

SEQ ID NO: 115279 - DNA, 25 bp, mus musculus
agaccactgacataccgagccaagc

SEQ ID NO: 115280 - DNA, 25 bp, mus musculus
ccactgacataccgagccaagcgta

SEQ ID NO: 115281 - DNA, 25 bp, mus musculus
cgtaccccaaagagggctggcatca

SEQ ID NO: 115282 - DNA, 25 bp, mus musculus
tccatgaacctctacacgacctaca

SEQ ID NO: 115283 - DNA, 25 bp, mus musculus
atgaacctctacacgacctacatcc

SEQ ID NO: 115284 - DNA, 25 bp, mus musculus
acgacctacatcctcatgggacgct

SEQ ID NO: 115285 - DNA, 25 bp, mus musculus
tacatcctcatgggacgctgggttc

SEQ ID NO: 115286 - DNA, 25 bp, mus musculus
ctcatgggacgctgggttctcggga

SEQ ID NO: 115287 - DNA, 25 bp, mus musculus
cgctgggttctcgggagtctggcct

SEQ ID NO: 115288 - DNA, 25 bp, mus musculus
gcctgtgacctttggcttgcactcg

SEQ ID NO: 115289 - DNA, 25 bp, mus musculus
tgtgacctttggcttgcactcgact

SEQ ID NO: 115290 - DNA, 25 bp, mus musculus
atgaccctcagcagctcctgctgga

SEQ ID NO: 115291 - DNA, 25 bp, mus musculus
ctcagcagctcctgctggactccaa

SEQ ID NO: 115292 - DNA, 25 bp, mus musculus
atgtgctgtcagccgagagaatgct

SEQ ID NO: 115293 - DNA, 25 bp, mus musculus
atattccagcgtagatcaaaccatg

SEQ ID NO: 115294 - DNA, 25 bp, mus musculus
agatcaaaccatgttagagactggc

SEQ ID NO: 115295 - DNA, 25 bp, mus musculus
ggtgcacagttgtcgccaatgctgc

SEQ ID NO: 115296 - DNA, 25 bp, mus musculus
cagttgtcgccaatgctgctcagaa

SEQ ID NO: 115297 - DNA, 25 bp, mus musculus
gtcagaacgaacagccactctgcag

SEQ ID NO: 115298 - DNA, 25 bp, mus musculus
acgaacagccactctgcagctccag

SEQ ID NO: 115299 - DNA, 25 bp, mus musculus
tctgcagctccagtcgccatataaa

SEQ ID NO: 115300 - DNA, 25 bp, mus musculus
aaatgccagttctacagagtggaag

SEQ ID NO: 115301 - DNA, 25 bp, mus musculus
gtgcctagctttgatctttgtatat

SEQ ID NO: 115302 - DNA, 25 bp, mus musculus
tgctggactccaagcacgtgttccc

SEQ ID NO: 115303 - DNA, 25 bp, mus musculus
tgttcccagttctgtttccatataa

SEQ ID NO: 115304 - DNA, 25 bp, mus musculus
tgtttccatataacccatctgctct

SEQ ID NO: 115305 - DNA, 25 bp, mus musculus
catataacccatctgctctgaccat

SEQ ID NO: 115306 - DNA, 25 bp, mus musculus
tggactcgatccacatcccggcctg

SEQ ID NO: 115307 - DNA, 25 bp, mus musculus
acatcccggcctgtctcaacctgga

SEQ ID NO: 115308 - DNA, 25 bp, mus musculus
cggcctgtctcaacctggagtttct

SEQ ID NO: 115309 - DNA, 25 bp, mus musculus
agtttctcaatgaagtctgaggatg

SEQ ID NO: 115310 - DNA, 25 bp, mus musculus
gtgccaagctcgcagaaggcgctgc

SEQ ID NO: 115311 - DNA, 25 bp, mus musculus
tgccaagctcgcagaaggcgctgct

SEQ ID NO: 115312 - DNA, 25 bp, mus musculus
ccttccggttcctcaccaagatgtg

SEQ ID NO: 115313 - DNA, 25 bp, mus musculus
cttccggttcctcaccaagatgtgg

SEQ ID NO: 115314 - DNA, 25 bp, mus musculus
tccggttcctcaccaagatgtggca

SEQ ID NO: 115315 - DNA, 25 bp, mus musculus
ccggttcctcaccaagatgtggcac

SEQ ID NO: 115316 - DNA, 25 bp, mus musculus
cggttcctcaccaagatgtggcacc

SEQ ID NO: 115317 - DNA, 25 bp, mus musculus
gttcctcaccaagatgtggcaccca

SEQ ID NO: 115318 - DNA, 25 bp, mus musculus
ttcctcaccaagatgtggcacccaa

SEQ ID NO: 115319 - DNA, 25 bp, mus musculus
tcctcaccaagatgtggcacccaaa

SEQ ID NO: 115320 - DNA, 25 bp, mus musculus
ctcaccaagatgtggcacccaaaca

SEQ ID NO: 115321 - DNA, 25 bp, mus musculus
caccaagatgtggcacccaaacatc

SEQ ID NO: 115322 - DNA, 25 bp, mus musculus
gccaagctcgcagaaggcgctgctg

SEQ ID NO: 115323 - DNA, 25 bp, mus musculus
caagctcgcagaaggcgctgctgct

SEQ ID NO: 115324 - DNA, 25 bp, mus musculus
tgctgctggaactgaaggggctgca

SEQ ID NO: 115325 - DNA, 25 bp, mus musculus
cggctacttcaaggctcgcctcaag

SEQ ID NO: 115326 - DNA, 25 bp, mus musculus
ggctacttcaaggctcgcctcaagt

SEQ ID NO: 115327 - DNA, 25 bp, mus musculus
ctacttcaaggctcgcctcaagttc

SEQ ID NO: 115328 - DNA, 25 bp, mus musculus
tacttcaaggctcgcctcaagttcc

SEQ ID NO: 115329 - DNA, 25 bp, mus musculus
aggctcgcctcaagttccccatcga

SEQ ID NO: 115330 - DNA, 25 bp, mus musculus
gttcgtgtcatccataccatgagga

SEQ ID NO: 115331 - DNA, 25 bp, mus musculus
gtcatccataccatgaggagctaca

SEQ ID NO: 115332 - DNA, 25 bp, mus musculus
tgcaccatcttggtgaacagcatga

SEQ ID NO: 115333 - DNA, 25 bp, mus musculus
gtcgcacacccagaggcaacaaaac

SEQ ID NO: 115334 - DNA, 25 bp, mus musculus
gcacacccagaggcaacaaaaccca

SEQ ID NO: 115335 - DNA, 25 bp, mus musculus
gcaacaaaacccacagaattcctga

SEQ ID NO: 115336 - DNA, 25 bp, mus musculus
cccacagaattcctgaaccaatggg

SEQ ID NO: 115337 - DNA, 25 bp, mus musculus
gaattcctgaaccaatgggagatgc

SEQ ID NO: 115338 - DNA, 25 bp, mus musculus
gagcttgcacatctgctaaaaattc

SEQ ID NO: 115339 - DNA, 25 bp, mus musculus
ctctgtcactgtgctggatccgtct

SEQ ID NO: 115340 - DNA, 25 bp, mus musculus
tgtcactgtgctggatccgtctaaa

SEQ ID NO: 115341 - DNA, 25 bp, mus musculus
gctggatccgtctaaagtgggacag

SEQ ID NO: 115342 - DNA, 25 bp, mus musculus
atccataccatgaggagctacatta

SEQ ID NO: 115343 - DNA, 25 bp, mus musculus
agctacattaggtcacatcattagg

SEQ ID NO: 115344 - DNA, 25 bp, mus musculus
attaggtcacatcattagggaagtt

SEQ ID NO: 115345 - DNA, 25 bp, mus musculus
gaagcatagctctacttgggtattt

SEQ ID NO: 115346 - DNA, 25 bp, mus musculus
gtcgctctgtgttctgtgtatgcat

SEQ ID NO: 115347 - DNA, 25 bp, mus musculus
ttccagtttaggtcaatctgtttct

SEQ ID NO: 115348 - DNA, 25 bp, mus musculus
tcaatctgtttcttcctttaagcag

SEQ ID NO: 115349 - DNA, 25 bp, mus musculus
cattgcaccatcttggtgaacagca

SEQ ID NO: 115350 - DNA, 25 bp, mus musculus
tcaaaacacagtcaccactgggatc

SEQ ID NO: 115351 - DNA, 25 bp, mus musculus
agtcaccactgggatcgtcagcacc

SEQ ID NO: 115352 - DNA, 25 bp, mus musculus
gattaacaccttgaaggtgacggcg

SEQ ID NO: 115353 - DNA, 25 bp, mus musculus
gggcatctccttcgcaattccatcc

SEQ ID NO: 115354 - DNA, 25 bp, mus musculus
ctccttcgcaattccatccgataag

SEQ ID NO: 115355 - DNA, 25 bp, mus musculus
cttcgcaattccatccgataagata

SEQ ID NO: 115356 - DNA, 25 bp, mus musculus
cgcaattccatccgataagataaaa

SEQ ID NO: 115357 - DNA, 25 bp, mus musculus
gttcttgacagagtcccacgatcga

SEQ ID NO: 115358 - DNA, 25 bp, mus musculus
cttgacagagtcccacgatcgacag

SEQ ID NO: 115359 - DNA, 25 bp, mus musculus
gacagagtcccacgatcgacaggcc

SEQ ID NO: 115360 - DNA, 25 bp, mus musculus
gtcccacgatcgacaggccaaaggg

SEQ ID NO: 115361 - DNA, 25 bp, mus musculus
gaaagctgtcaccaagaagaagtat

SEQ ID NO: 115362 - DNA, 25 bp, mus musculus
tcggaactccgatatggactacatt

SEQ ID NO: 115363 - DNA, 25 bp, mus musculus
tatggactacattcagacagacgct

SEQ ID NO: 115364 - DNA, 25 bp, mus musculus
ggactacattcagacagacgctatc

SEQ ID NO: 115365 - DNA, 25 bp, mus musculus
cattcagacagacgctatcatcaat

SEQ ID NO: 115366 - DNA, 25 bp, mus musculus
tcagacagacgctatcatcaattat

SEQ ID NO: 115367 - DNA, 25 bp, mus musculus
gacagacgctatcatcaattatgga

SEQ ID NO: 115368 - DNA, 25 bp, mus musculus
agacgctatcatcaattatggaaat

SEQ ID NO: 115369 - DNA, 25 bp, mus musculus
agtaaacctggatggcgaggtgatt

SEQ ID NO: 115370 - DNA, 25 bp, mus musculus
ccgctgagcgtgatctcgcctccat

SEQ ID NO: 115371 - DNA, 25 bp, mus musculus
agcgtgatctcgcctccatcatgaa

SEQ ID NO: 115372 - DNA, 25 bp, mus musculus
gatccgcaactgtctatgaaatgct

SEQ ID NO: 115373 - DNA, 25 bp, mus musculus
aaatgcttgcccaggcccagcgtga

SEQ ID NO: 115374 - DNA, 25 bp, mus musculus
tacactattgcctggcgcagaaaga

SEQ ID NO: 115375 - DNA, 25 bp, mus musculus
aaacggcaggatcaccattgcttga

SEQ ID NO: 115376 - DNA, 25 bp, mus musculus
caccattgcttgactgtgaccacat

SEQ ID NO: 115377 - DNA, 25 bp, mus musculus
actgtgaccacatcagggccttgaa

SEQ ID NO: 115378 - DNA, 25 bp, mus musculus
accacatcagggccttgaatctttg

SEQ ID NO: 115379 - DNA, 25 bp, mus musculus
ccttgaatctttgtacctgacagac

SEQ ID NO: 115380 - DNA, 25 bp, mus musculus
atctttgtacctgacagacctggga

SEQ ID NO: 115381 - DNA, 25 bp, mus musculus
gtacctgacagacctgggacctgga

SEQ ID NO: 115382 - DNA, 25 bp, mus musculus
agaagctcttgaccaagtacgacaa

SEQ ID NO: 115383 - DNA, 25 bp, mus musculus
tcaataaaactgcgtctcacatttt

SEQ ID NO: 115384 - DNA, 25 bp, mus musculus
tcttgaccaagtacgacaatctatt

SEQ ID NO: 115385 - DNA, 25 bp, mus musculus
ccaagtacgacaatctatttgagac

SEQ ID NO: 115386 - DNA, 25 bp, mus musculus
ttgagacatcctttccctactccat

SEQ ID NO: 115387 - DNA, 25 bp, mus musculus
ttccctactccatgggctggcatgg

SEQ ID NO: 115388 - DNA, 25 bp, mus musculus
agactggagccacctgtgaccactg

SEQ ID NO: 115389 - DNA, 25 bp, mus musculus
gaccgtgtacactggcagctcacgc

SEQ ID NO: 115390 - DNA, 25 bp, mus musculus
gtacactggcagctcacgcccacta

SEQ ID NO: 115391 - DNA, 25 bp, mus musculus
cagagacgtgccttctcatctgcta

SEQ ID NO: 115392 - DNA, 25 bp, mus musculus
cgtgccttctcatctgctatacaac

SEQ ID NO: 115393 - DNA, 25 bp, mus musculus
acagcgcccagagtgcggttgatgg

SEQ ID NO: 115394 - DNA, 25 bp, mus musculus
cggttgatgggcgcaccgtgaacct

SEQ ID NO: 115395 - DNA, 25 bp, mus musculus
ttgatgggcgcaccgtgaacctaaa

SEQ ID NO: 115396 - DNA, 25 bp, mus musculus
ggcgcaccgtgaacctaaacctgtg

SEQ ID NO: 115397 - DNA, 25 bp, mus musculus
tgaacctaaacctgtgggacactgc

SEQ ID NO: 115398 - DNA, 25 bp, mus musculus
taaacctgtgggacactgcgggcca

SEQ ID NO: 115399 - DNA, 25 bp, mus musculus
acactgcgggccaggaggaatatga

SEQ ID NO: 115400 - DNA, 25 bp, mus musculus
accctcagaccaacgtcttcgtcat

SEQ ID NO: 115401 - DNA, 25 bp, mus musculus
ctcagaccaacgtcttcgtcatctg

SEQ ID NO: 115402 - DNA, 25 bp, mus musculus
cctcctatgagaacgtgaggcacaa

SEQ ID NO: 115403 - DNA, 25 bp, mus musculus
gccttctcatctgctatacaactaa

SEQ ID NO: 115404 - DNA, 25 bp, mus musculus
ggcacaaatggcacccagaggtttg

SEQ ID NO: 115405 - DNA, 25 bp, mus musculus
ttctcatctgctatacaactaacgc

SEQ ID NO: 115406 - DNA, 25 bp, mus musculus
tcatctgctatacaactaacgcctt

SEQ ID NO: 115407 - DNA, 25 bp, mus musculus
ccaaggaatacatccccactgtgtt

SEQ ID NO: 115408 - DNA, 25 bp, mus musculus
tccccactgtgtttgacaattacag

SEQ ID NO: 115409 - DNA, 25 bp, mus musculus
ttgacaattacagcgcccagagtgc

SEQ ID NO: 115410 - DNA, 25 bp, mus musculus
acaattacagcgcccagagtgcggt

SEQ ID NO: 115411 - DNA, 25 bp, mus musculus
attacagcgcccagagtgcggttga

SEQ ID NO: 115412 - DNA, 25 bp, mus musculus
accccagcaaggacactgagcaaga

SEQ ID NO: 115413 - DNA, 25 bp, mus musculus
ccccagcaaggacactgagcaagag

SEQ ID NO: 115414 - DNA, 25 bp, mus musculus
ctctcttgaataccatcaataaagt

SEQ ID NO: 115415 - DNA, 25 bp, mus musculus
tctcttgaataccatcaataaagtt

SEQ ID NO: 115416 - DNA, 25 bp, mus musculus
ctcttgaataccatcaataaagttc

SEQ ID NO: 115417 - DNA, 25 bp, mus musculus
tcttgaataccatcaataaagttcg

SEQ ID NO: 115418 - DNA, 25 bp, mus musculus
cttgaataccatcaataaagttcgc

SEQ ID NO: 115419 - DNA, 25 bp, mus musculus
ttgaataccatcaataaagttcgct

SEQ ID NO: 115420 - DNA, 25 bp, mus musculus
tgaataccatcaataaagttcgctg

SEQ ID NO: 115421 - DNA, 25 bp, mus musculus
aataccatcaataaagttcgctgca

SEQ ID NO: 115422 - DNA, 25 bp, mus musculus
taccatcaataaagttcgctgcacc

SEQ ID NO: 115423 - DNA, 25 bp, mus musculus
accatcaataaagttcgctgcaccc

SEQ ID NO: 115424 - DNA, 25 bp, mus musculus
cccagcaaggacactgagcaagaga

SEQ ID NO: 115425 - DNA, 25 bp, mus musculus
ctccctactctcttgaataccatca

SEQ ID NO: 115426 - DNA, 25 bp, mus musculus
tccctactctcttgaataccatcaa

SEQ ID NO: 115427 - DNA, 25 bp, mus musculus
ccctactctcttgaataccatcaat

SEQ ID NO: 115428 - DNA, 25 bp, mus musculus
cctactctcttgaataccatcaata

SEQ ID NO: 115429 - DNA, 25 bp, mus musculus
ctactctcttgaataccatcaataa

SEQ ID NO: 115430 - DNA, 25 bp, mus musculus
tactctcttgaataccatcaataaa

SEQ ID NO: 115431 - DNA, 25 bp, mus musculus
actctcttgaataccatcaataaag

SEQ ID NO: 115432 - DNA, 25 bp, mus musculus
agagttttctcagccataatactta

SEQ ID NO: 115433 - DNA, 25 bp, mus musculus
tcagccataatacttaactggaaag

SEQ ID NO: 115434 - DNA, 25 bp, mus musculus
gcagtcattcacattctgatgtgtg

SEQ ID NO: 115435 - DNA, 25 bp, mus musculus
cacattctgatgtgtggactgcaca

SEQ ID NO: 115436 - DNA, 25 bp, mus musculus
tttagttagtcctattctgctatgc

SEQ ID NO: 115437 - DNA, 25 bp, mus musculus
tagtcctattctgctatgctgtctc

SEQ ID NO: 115438 - DNA, 25 bp, mus musculus
tcctattctgctatgctgtctcatg

SEQ ID NO: 115439 - DNA, 25 bp, mus musculus
tattctgctatgctgtctcatgaag

SEQ ID NO: 115440 - DNA, 25 bp, mus musculus
ttacagactgtatacccaggacaga

SEQ ID NO: 115441 - DNA, 25 bp, mus musculus
actgtatacccaggacagagctgtt

SEQ ID NO: 115442 - DNA, 25 bp, mus musculus
gtatacccaggacagagctgttttg

SEQ ID NO: 115443 - DNA, 25 bp, mus musculus
tacccaggacagagctgttttgtat

SEQ ID NO: 115444 - DNA, 25 bp, mus musculus
gttcatctctgatccctgaccaaac

SEQ ID NO: 115445 - DNA, 25 bp, mus musculus
atgttgcctgtgcaaccccttagga

SEQ ID NO: 115446 - DNA, 25 bp, mus musculus
ttgcctgtgcaaccccttaggaata

SEQ ID NO: 115447 - DNA, 25 bp, mus musculus
ttacacacagagaagctgtgtttag

SEQ ID NO: 115448 - DNA, 25 bp, mus musculus
gaaatacacatgcctaagctagcag

SEQ ID NO: 115449 - DNA, 25 bp, mus musculus
cacatgcctaagctagcagtcattc

SEQ ID NO: 115450 - DNA, 25 bp, mus musculus
atgcctaagctagcagtcattcaca

SEQ ID NO: 115451 - DNA, 25 bp, mus musculus
cctaagctagcagtcattcacattc

SEQ ID NO: 115452 - DNA, 25 bp, mus musculus
cctaagcactcacagacgaaaagcc

SEQ ID NO: 115453 - DNA, 25 bp, mus musculus
gtggctcctgaacacttgaccctgt

SEQ ID NO: 115454 - DNA, 25 bp, mus musculus
tgcctccaaggactgtctggcgatg

SEQ ID NO: 115455 - DNA, 25 bp, mus musculus
caaggactgtctggcgatgacttgt

SEQ ID NO: 115456 - DNA, 25 bp, mus musculus
tattggccaccaactgtagatgtat

SEQ ID NO: 115457 - DNA, 25 bp, mus musculus
ccaccaactgtagatgtatatacgg

SEQ ID NO: 115458 - DNA, 25 bp, mus musculus
gtgtccttctgatgctaagactcca

SEQ ID NO: 115459 - DNA, 25 bp, mus musculus
ttctgatgctaagactccagacctt

SEQ ID NO: 115460 - DNA, 25 bp, mus musculus
tgctaagactccagacctttcttgt

SEQ ID NO: 115461 - DNA, 25 bp, mus musculus
cttgctttctctgattttataccaa

SEQ ID NO: 115462 - DNA, 25 bp, mus musculus
ttctctgattttataccaactgtgt

SEQ ID NO: 115463 - DNA, 25 bp, mus musculus
ataccaactgtgtggactaagatgc

SEQ ID NO: 115464 - DNA, 25 bp, mus musculus
tggggccacacgtttaaatgagaag

SEQ ID NO: 115465 - DNA, 25 bp, mus musculus
cggttcataactgctttcataccta

SEQ ID NO: 115466 - DNA, 25 bp, mus musculus
ataactgctttcatacctagctagg

SEQ ID NO: 115467 - DNA, 25 bp, mus musculus
atacctagctaggctgttgttatta

SEQ ID NO: 115468 - DNA, 25 bp, mus musculus
caaagccttcgtcagtcccacagtt

SEQ ID NO: 115469 - DNA, 25 bp, mus musculus
cacagttttctcacggtcggagcat

SEQ ID NO: 115470 - DNA, 25 bp, mus musculus
tctagacccttgggactagcgagtt

SEQ ID NO: 115471 - DNA, 25 bp, mus musculus
tccctggctttctgggtctagagtg

SEQ ID NO: 115472 - DNA, 25 bp, mus musculus
ggctgacccaaaacagggcgcatgc

SEQ ID NO: 115473 - DNA, 25 bp, mus musculus
cccaaaacagggcgcatgcctagcc

SEQ ID NO: 115474 - DNA, 25 bp, mus musculus
ctcgttacctccaaaggctgctctg

SEQ ID NO: 115475 - DNA, 25 bp, mus musculus
acctccaaaggctgctctgcagagg

SEQ ID NO: 115476 - DNA, 25 bp, mus musculus
tgtgcacactgccagcgaccttgaa

SEQ ID NO: 115477 - DNA, 25 bp, mus musculus
cactgccagcgaccttgaatagcca

SEQ ID NO: 115478 - DNA, 25 bp, mus musculus
cagcgaccttgaatagccagacacc

SEQ ID NO: 115479 - DNA, 25 bp, mus musculus
tgctcacaaggcccctgctctgttg

SEQ ID NO: 115480 - DNA, 25 bp, mus musculus
atattttgcattacactttgatact

SEQ ID NO: 115481 - DNA, 25 bp, mus musculus
tgcattacactttgatactacactc

SEQ ID NO: 115482 - DNA, 25 bp, mus musculus
gcacaccaacagcattccccttttt

SEQ ID NO: 115483 - DNA, 25 bp, mus musculus
tgaatccaaatctctctgtagtatt

SEQ ID NO: 115484 - DNA, 25 bp, mus musculus
cgcatgcctagccttgtaccaggct

SEQ ID NO: 115485 - DNA, 25 bp, mus musculus
cttgtaccaggctggaagacacctc

SEQ ID NO: 115486 - DNA, 25 bp, mus musculus
caggcccacactgatccacctagat

SEQ ID NO: 115487 - DNA, 25 bp, mus musculus
cacactgatccacctagatgcgggc

SEQ ID NO: 115488 - DNA, 25 bp, mus musculus
gatccacctagatgcgggcctggta

SEQ ID NO: 115489 - DNA, 25 bp, mus musculus
agagatgatttcctctgatggtctt

SEQ ID NO: 115490 - DNA, 25 bp, mus musculus
gatttcctctgatggtcttccatgg

SEQ ID NO: 115491 - DNA, 25 bp, mus musculus
tggtcttccatggtcctcgtagcac

SEQ ID NO: 115492 - DNA, 25 bp, mus musculus
ggtaactccagcaatgccactagca

SEQ ID NO: 115493 - DNA, 25 bp, mus musculus
tccagcaatgccactagcagcagca

SEQ ID NO: 115494 - DNA, 25 bp, mus musculus
agcctggtcctggctgacagtcatg

SEQ ID NO: 115495 - DNA, 25 bp, mus musculus
gtcctggctgacagtcatggggaca

SEQ ID NO: 115496 - DNA, 25 bp, mus musculus
ataatcaccgcgtaatcagcgcccc

SEQ ID NO: 115497 - DNA, 25 bp, mus musculus
tcaaattcctgctcggacttgggac

SEQ ID NO: 115498 - DNA, 25 bp, mus musculus
ttgtctgggaacaactcctgaagaa

SEQ ID NO: 115499 - DNA, 25 bp, mus musculus
tcaaacacctttccaggtggagctc

SEQ ID NO: 115500 - DNA, 25 bp, mus musculus
aagcctgcgttcttacagagaagcc

SEQ ID NO: 115501 - DNA, 25 bp, mus musculus
agaagcccaccttggctgcaagcac

SEQ ID NO: 115502 - DNA, 25 bp, mus musculus
ccaccttggctgcaagcacagcaca

SEQ ID NO: 115503 - DNA, 25 bp, mus musculus
gcagagacttcttccttccttattc

SEQ ID NO: 115504 - DNA, 25 bp, mus musculus
aatgccactagcagcagcagcagca

SEQ ID NO: 115505 - DNA, 25 bp, mus musculus
actagcagcagcagcagcagtgaag

SEQ ID NO: 115506 - DNA, 25 bp, mus musculus
acagagcccgggctgtcatctcact

SEQ ID NO: 115507 - DNA, 25 bp, mus musculus
ctgtcatctcactatgggcacagca

SEQ ID NO: 115508 - DNA, 25 bp, mus musculus
agctccatgtcccagacttcagtct

SEQ ID NO: 115509 - DNA, 25 bp, mus musculus
gtctgctctaagctgtccccacaag

SEQ ID NO: 115510 - DNA, 25 bp, mus musculus
ggctatgcatctcctgtcactcaga

SEQ ID NO: 115511 - DNA, 25 bp, mus musculus
agctccaagcaggactcttggaaca

SEQ ID NO: 115512 - DNA, 25 bp, mus musculus
agcagactacgaccttcacaggaca

SEQ ID NO: 115513 - DNA, 25 bp, mus musculus
gcctctcactgagtcctgacttgaa

SEQ ID NO: 115514 - DNA, 25 bp, mus musculus
gcctcctgttagccggctatgacga

SEQ ID NO: 115515 - DNA, 25 bp, mus musculus
tgttagccggctatgacgacttcaa

SEQ ID NO: 115516 - DNA, 25 bp, mus musculus
atgacgacttcaactgcagtgtgtg

SEQ ID NO: 115517 - DNA, 25 bp, mus musculus
acttcaactgcagtgtgtgggacgc

SEQ ID NO: 115518 - DNA, 25 bp, mus musculus
actgcagtgtgtgggacgctctgaa

SEQ ID NO: 115519 - DNA, 25 bp, mus musculus
tccttgctggtcatgacaaccgtgt

SEQ ID NO: 115520 - DNA, 25 bp, mus musculus
catattttctgttctccaatgatac

SEQ ID NO: 115521 - DNA, 25 bp, mus musculus
ttctgttctccaatgatacctggag

SEQ ID NO: 115522 - DNA, 25 bp, mus musculus
tctccaatgatacctggagaaatcc

SEQ ID NO: 115523 - DNA, 25 bp, mus musculus
cgtgttacagcctatagctgtgagg

SEQ ID NO: 115524 - DNA, 25 bp, mus musculus
cttgtgatgcatcctcaaagctgtg

SEQ ID NO: 115525 - DNA, 25 bp, mus musculus
gacagtctttcaccggacacatctc

SEQ ID NO: 115526 - DNA, 25 bp, mus musculus
ctttcaccggacacatctcagacat

SEQ ID NO: 115527 - DNA, 25 bp, mus musculus
ccggacacatctcagacatcaacgc

SEQ ID NO: 115528 - DNA, 25 bp, mus musculus
acatctcagacatcaacgctgtcag

SEQ ID NO: 115529 - DNA, 25 bp, mus musculus
aggagctcctgctatactctcatga

SEQ ID NO: 115530 - DNA, 25 bp, mus musculus
tcctgctatactctcatgacaatat

SEQ ID NO: 115531 - DNA, 25 bp, mus musculus
tatactctcatgacaatatcatctg

SEQ ID NO: 115532 - DNA, 25 bp, mus musculus
gccccactacctgcgctggtgtgtg

SEQ ID NO: 115533 - DNA, 25 bp, mus musculus
cccactacctgcgctggtgtgtgct

SEQ ID NO: 115534 - DNA, 25 bp, mus musculus
caggccacgctcagagcagggaaag

SEQ ID NO: 115535 - DNA, 25 bp, mus musculus
tacagagctcaaccggaagaaacca

SEQ ID NO: 115536 - DNA, 25 bp, mus musculus
cagagctcaaccggaagaaaccagg

SEQ ID NO: 115537 - DNA, 25 bp, mus musculus
gaaaccaggacatcagctaaccctg

SEQ ID NO: 115538 - DNA, 25 bp, mus musculus
aaccaggacatcagctaaccctgca

SEQ ID NO: 115539 - DNA, 25 bp, mus musculus
ccaggacatcagctaaccctgcagg

SEQ ID NO: 115540 - DNA, 25 bp, mus musculus
catcagctaaccctgcaggagagcg

SEQ ID NO: 115541 - DNA, 25 bp, mus musculus
tcagctaaccctgcaggagagcgcg

SEQ ID NO: 115542 - DNA, 25 bp, mus musculus
agctaaccctgcaggagagcgcggg

SEQ ID NO: 115543 - DNA, 25 bp, mus musculus
tgagaactcacacacacacacaagc

SEQ ID NO: 115544 - DNA, 25 bp, mus musculus
ctacctgcgctggtgtgtgctgtca

SEQ ID NO: 115545 - DNA, 25 bp, mus musculus
gtgctgtcagcgcccgagatccaga

SEQ ID NO: 115546 - DNA, 25 bp, mus musculus
atatggctgtggcttcagccgccag

SEQ ID NO: 115547 - DNA, 25 bp, mus musculus
tcagccgccagaatctcaggccacg

SEQ ID NO: 115548 - DNA, 25 bp, mus musculus
agccgccagaatctcaggccacgct

SEQ ID NO: 115549 - DNA, 25 bp, mus musculus
gccagaatctcaggccacgctcaga

SEQ ID NO: 115550 - DNA, 25 bp, mus musculus
gaatctcaggccacgctcagagcag

SEQ ID NO: 115551 - DNA, 25 bp, mus musculus
ctcaggccacgctcagagcagggaa

SEQ ID NO: 115552 - DNA, 25 bp, mus musculus
gcttgctctaagctgggattggcat

SEQ ID NO: 115553 - DNA, 25 bp, mus musculus
aatctgaacatatccatggaacaca

SEQ ID NO: 115554 - DNA, 25 bp, mus musculus
gaatgacttctacacagaatggaga

SEQ ID NO: 115555 - DNA, 25 bp, mus musculus
cttctacacagaatggagaactcaa

SEQ ID NO: 115556 - DNA, 25 bp, mus musculus
ttctattcctctgaggctcataatc

SEQ ID NO: 115557 - DNA, 25 bp, mus musculus
tcctctgaggctcataatcacagtg

SEQ ID NO: 115558 - DNA, 25 bp, mus musculus
cataatcacagtgccaactcttgtg

SEQ ID NO: 115559 - DNA, 25 bp, mus musculus
cacagtgccaactcttgtgaaacca

SEQ ID NO: 115560 - DNA, 25 bp, mus musculus
tcttttgctgctatgacatgatttg

SEQ ID NO: 115561 - DNA, 25 bp, mus musculus
tgatttgcatatctctgaagataaa

SEQ ID NO: 115562 - DNA, 25 bp, mus musculus
taaatgccttttacaatgtggcaga

SEQ ID NO: 115563 - DNA, 25 bp, mus musculus
ccttttacaatgtggcagaagcact

SEQ ID NO: 115564 - DNA, 25 bp, mus musculus
aacatatccatggaacacagctcct

SEQ ID NO: 115565 - DNA, 25 bp, mus musculus
tccatggaacacagctcctagggcc

SEQ ID NO: 115566 - DNA, 25 bp, mus musculus
gaacacagctcctagggcctcatgc

SEQ ID NO: 115567 - DNA, 25 bp, mus musculus
agctcctagggcctcatgctatctg

SEQ ID NO: 115568 - DNA, 25 bp, mus musculus
tagggcctcatgctatctgcagaca

SEQ ID NO: 115569 - DNA, 25 bp, mus musculus
ctatctgcagacattggttcccagg

SEQ ID NO: 115570 - DNA, 25 bp, mus musculus
gcagacattggttcccagggtagac

SEQ ID NO: 115571 - DNA, 25 bp, mus musculus
gcagtgcccaatgtgggaaggctct

SEQ ID NO: 115572 - DNA, 25 bp, mus musculus
atgcgagctgccagtcctacctcag

SEQ ID NO: 115573 - DNA, 25 bp, mus musculus
tcagcccatcttgaaaacaatctta

SEQ ID NO: 115574 - DNA, 25 bp, mus musculus
acagtggtgactgtccgggaaggca

SEQ ID NO: 115575 - DNA, 25 bp, mus musculus
gtctatgactctttggacaaggccc

SEQ ID NO: 115576 - DNA, 25 bp, mus musculus
gactctttggacaaggccctgaagg

SEQ ID NO: 115577 - DNA, 25 bp, mus musculus
tctttggacaaggccctgaaggtgc

SEQ ID NO: 115578 - DNA, 25 bp, mus musculus
cggggtctcaaccaggactgctgtg

SEQ ID NO: 115579 - DNA, 25 bp, mus musculus
ggtctcaaccaggactgctgtgtgg

SEQ ID NO: 115580 - DNA, 25 bp, mus musculus
aaccaggactgctgtgtggtctaca

SEQ ID NO: 115581 - DNA, 25 bp, mus musculus
caggactgctgtgtggtctacaggc

SEQ ID NO: 115582 - DNA, 25 bp, mus musculus
gtggtctacaggctcatcaaaggaa

SEQ ID NO: 115583 - DNA, 25 bp, mus musculus
gtctacaggctcatcaaaggaagaa

SEQ ID NO: 115584 - DNA, 25 bp, mus musculus
gcccatcttgaaaacaatcttaggc

SEQ ID NO: 115585 - DNA, 25 bp, mus musculus
aggcaacatggaaccaccacgaggc

SEQ ID NO: 115586 - DNA, 25 bp, mus musculus
ccctcctgttagtggggctgagcat

SEQ ID NO: 115587 - DNA, 25 bp, mus musculus
tctcgggcagttggcactgtcaaag

SEQ ID NO: 115588 - DNA, 25 bp, mus musculus
gtgtacctgcctaacaagcaacgca

SEQ ID NO: 115589 - DNA, 25 bp, mus musculus
tacctgcctaacaagcaacgcacag

SEQ ID NO: 115590 - DNA, 25 bp, mus musculus
ctgcctaacaagcaacgcacagtgg

SEQ ID NO: 115591 - DNA, 25 bp, mus musculus
caacgcacagtggtgactgtccggg

SEQ ID NO: 115592 - DNA, 25 bp, mus musculus
caagcatgcacatcaaattcaccag

SEQ ID NO: 115593 - DNA, 25 bp, mus musculus
gcatgcacatcaaattcaccagaag

SEQ ID NO: 115594 - DNA, 25 bp, mus musculus
atgtcttccggctgctgcctttgtg

SEQ ID NO: 115595 - DNA, 25 bp, mus musculus
tgctgcctttgtgggcagagctaat

SEQ ID NO: 115596 - DNA, 25 bp, mus musculus
tgcctttgtgggcagagctaatcca

SEQ ID NO: 115597 - DNA, 25 bp, mus musculus
taatccaagttactgttctctgttc

SEQ ID NO: 115598 - DNA, 25 bp, mus musculus
tccaagttactgttctctgttcaaa

SEQ ID NO: 115599 - DNA, 25 bp, mus musculus
aagttactgttctctgttcaaatga

SEQ ID NO: 115600 - DNA, 25 bp, mus musculus
ttctctgttcaaatgaagcagcttc

SEQ ID NO: 115601 - DNA, 25 bp, mus musculus
ttttgaattctccaataaatctgga

SEQ ID NO: 115602 - DNA, 25 bp, mus musculus
tgaattctccaataaatctggacaa

SEQ ID NO: 115603 - DNA, 25 bp, mus musculus
attctccaataaatctggacaatgc

SEQ ID NO: 115604 - DNA, 25 bp, mus musculus
tgcacatcaaattcaccagaagtac

SEQ ID NO: 115605 - DNA, 25 bp, mus musculus
tcaaattcaccagaagtacaaccca

SEQ ID NO: 115606 - DNA, 25 bp, mus musculus
aattcaccagaagtacaacccatcg

SEQ ID NO: 115607 - DNA, 25 bp, mus musculus
tcaccagaagtacaacccatcggcg

SEQ ID NO: 115608 - DNA, 25 bp, mus musculus
gaagtacaacccatcggcgcagtca

SEQ ID NO: 115609 - DNA, 25 bp, mus musculus
atcggcgcagtcagaggatggagtc

SEQ ID NO: 115610 - DNA, 25 bp, mus musculus
tggagtctgatgtcttccggctgct

SEQ ID NO: 115611 - DNA, 25 bp, mus musculus
ctgatgtcttccggctgctgccttt

SEQ ID NO: 115612 - DNA, 25 bp, mus musculus
aggtctcaggaatctcttcgcttca

SEQ ID NO: 115613 - DNA, 25 bp, mus musculus
gtctcaggaatctcttcgcttcagc

SEQ ID NO: 115614 - DNA, 25 bp, mus musculus
tacacttcaatcctcgctctcaatg

SEQ ID NO: 115615 - DNA, 25 bp, mus musculus
tcaatcctcgctctcaatgcccatg

SEQ ID NO: 115616 - DNA, 25 bp, mus musculus
tcctcgctctcaatgcccatggaga

SEQ ID NO: 115617 - DNA, 25 bp, mus musculus
ctctcaatgcccatggagacgccaa

SEQ ID NO: 115618 - DNA, 25 bp, mus musculus
ctcaatgcccatggagacgccaaca

SEQ ID NO: 115619 - DNA, 25 bp, mus musculus
atgcccatggagacgccaacaccat

SEQ ID NO: 115620 - DNA, 25 bp, mus musculus
agacgccaacaccattgtgtgtaac

SEQ ID NO: 115621 - DNA, 25 bp, mus musculus
acgccaacaccattgtgtgtaacac

SEQ ID NO: 115622 - DNA, 25 bp, mus musculus
gccaacaccattgtgtgtaacacca

SEQ ID NO: 115623 - DNA, 25 bp, mus musculus
caacaccattgtgtgtaacaccaag

SEQ ID NO: 115624 - DNA, 25 bp, mus musculus
ctcaggaatctcttcgcttcagctt

SEQ ID NO: 115625 - DNA, 25 bp, mus musculus
caggaatctcttcgcttcagcttca

SEQ ID NO: 115626 - DNA, 25 bp, mus musculus
ttcgcttcagcttcaatcatggcct

SEQ ID NO: 115627 - DNA, 25 bp, mus musculus
cgcttcagcttcaatcatggcctgt

SEQ ID NO: 115628 - DNA, 25 bp, mus musculus
cttcagcttcaatcatggcctgtgg

SEQ ID NO: 115629 - DNA, 25 bp, mus musculus
tcagcttcaatcatggcctgtggtc

SEQ ID NO: 115630 - DNA, 25 bp, mus musculus
agcttcaatcatggcctgtggtctg

SEQ ID NO: 115631 - DNA, 25 bp, mus musculus
cttcaatcatggcctgtggtctggt

SEQ ID NO: 115632 - DNA, 25 bp, mus musculus
gtgctcagagtctaccttggtgctt

SEQ ID NO: 115633 - DNA, 25 bp, mus musculus
agagtctaccttggtgcttgggacg

SEQ ID NO: 115634 - DNA, 25 bp, mus musculus
acagtgcccgagtcgttccatccag

SEQ ID NO: 115635 - DNA, 25 bp, mus musculus
tcgttccatccaggaggaaattagt

SEQ ID NO: 115636 - DNA, 25 bp, mus musculus
aggcaaggcttggtgtcggctcacg

SEQ ID NO: 115637 - DNA, 25 bp, mus musculus
gctcacgctggccatgtgtgaagtg

SEQ ID NO: 115638 - DNA, 25 bp, mus musculus
tgaagtgacctcagtcgtcagtcac

SEQ ID NO: 115639 - DNA, 25 bp, mus musculus
ccacacctgaggcattgccacaggc

SEQ ID NO: 115640 - DNA, 25 bp, mus musculus
ctgaggcattgccacaggctggcca

SEQ ID NO: 115641 - DNA, 25 bp, mus musculus
cattgccacaggctggccatgctca

SEQ ID NO: 115642 - DNA, 25 bp, mus musculus
cacaggctggccatgctcaacttgt

SEQ ID NO: 115643 - DNA, 25 bp, mus musculus
atgctcaacttgttcaggaaggtgg

SEQ ID NO: 115644 - DNA, 25 bp, mus musculus
gtgccctggccacggctgtgctgac

SEQ ID NO: 115645 - DNA, 25 bp, mus musculus
tgctgactctgcctcctgtggtaca

SEQ ID NO: 115646 - DNA, 25 bp, mus musculus
ctcctgtggtacagcatgaggccca

SEQ ID NO: 115647 - DNA, 25 bp, mus musculus
tggtacagcatgaggcccagggaag

SEQ ID NO: 115648 - DNA, 25 bp, mus musculus
ttctatttctcagcgtgtgcagtga

SEQ ID NO: 115649 - DNA, 25 bp, mus musculus
caaggctccagggctgtcactctga

SEQ ID NO: 115650 - DNA, 25 bp, mus musculus
tccagggctgtcactctgatgacaa

SEQ ID NO: 115651 - DNA, 25 bp, mus musculus
gctgtcactctgatgacaacagtgc

SEQ ID NO: 115652 - DNA, 25 bp, mus musculus
actcaagttccagaagtgttcctca

SEQ ID NO: 115653 - DNA, 25 bp, mus musculus
tgtgacactcaggattctgttgcct

SEQ ID NO: 115654 - DNA, 25 bp, mus musculus
ctgcagtcctgatcagggcccgtgc

SEQ ID NO: 115655 - DNA, 25 bp, mus musculus
tcctgatcagggcccgtgcactagc

SEQ ID NO: 115656 - DNA, 25 bp, mus musculus
cccgtgcactagcttggatcttgaa

SEQ ID NO: 115657 - DNA, 25 bp, mus musculus
tcttgaactgaaccactctggaaaa

SEQ ID NO: 115658 - DNA, 25 bp, mus musculus
actgaaccactctggaaaattgcca

SEQ ID NO: 115659 - DNA, 25 bp, mus musculus
attgccactggtaacaaaatcaagc

SEQ ID NO: 115660 - DNA, 25 bp, mus musculus
atcaagcaccacagagatggccttc

SEQ ID NO: 115661 - DNA, 25 bp, mus musculus
agagatggccttccaagaagatcac

SEQ ID NO: 115662 - DNA, 25 bp, mus musculus
agatcaccaagataattccattttt

SEQ ID NO: 115663 - DNA, 25 bp, mus musculus
tcttagctacaatgtttttggagaa

SEQ ID NO: 115664 - DNA, 25 bp, mus musculus
actcaggattctgttgcctgtttca

SEQ ID NO: 115665 - DNA, 25 bp, mus musculus
tgtttcagcactcagagtcccctgc

SEQ ID NO: 115666 - DNA, 25 bp, mus musculus
agcactcagagtcccctgctgaaga

SEQ ID NO: 115667 - DNA, 25 bp, mus musculus
cagagtcccctgctgaagaggcaac

SEQ ID NO: 115668 - DNA, 25 bp, mus musculus
tctccggcagagctgaaagacatgg

SEQ ID NO: 115669 - DNA, 25 bp, mus musculus
tttgcctctaagtgctgctctataa

SEQ ID NO: 115670 - DNA, 25 bp, mus musculus
ctctactgcagctcacagattgatg

SEQ ID NO: 115671 - DNA, 25 bp, mus musculus
atgatagacaccctgcagtcctgat

SEQ ID NO: 115672 - DNA, 25 bp, mus musculus
gagcctgacctactgccctgctatt

SEQ ID NO: 115673 - DNA, 25 bp, mus musculus
ccagcaatgacacgggtctccaact

SEQ ID NO: 115674 - DNA, 25 bp, mus musculus
cgccctcaacttagctccactgtga

SEQ ID NO: 115675 - DNA, 25 bp, mus musculus
caacttagctccactgtgagttaga

SEQ ID NO: 115676 - DNA, 25 bp, mus musculus
ggaaattgccacctgaaggaaagag

SEQ ID NO: 115677 - DNA, 25 bp, mus musculus
agattctcggggtttgcaggaggca

SEQ ID NO: 115678 - DNA, 25 bp, mus musculus
aggcagtcctgtgtcacaaatactc

SEQ ID NO: 115679 - DNA, 25 bp, mus musculus
cccacacagtgcactgaggagaaga

SEQ ID NO: 115680 - DNA, 25 bp, mus musculus
agaggcatggggttgccttgcttct

SEQ ID NO: 115681 - DNA, 25 bp, mus musculus
ttgccttgcttctcctatgagcaaa

SEQ ID NO: 115682 - DNA, 25 bp, mus musculus
tgcttctcctatgagcaaaacccat

SEQ ID NO: 115683 - DNA, 25 bp, mus musculus
tcctatgagcaaaacccattaaagt

SEQ ID NO: 115684 - DNA, 25 bp, mus musculus
cacagcagctcagccactgtggaaa

SEQ ID NO: 115685 - DNA, 25 bp, mus musculus
agctcagccactgtggaaagattag

SEQ ID NO: 115686 - DNA, 25 bp, mus musculus
gggacctaaccagcgcagtcatcag

SEQ ID NO: 115687 - DNA, 25 bp, mus musculus
taaccagcgcagtcatcagatgtga

SEQ ID NO: 115688 - DNA, 25 bp, mus musculus
tcatcagatgtgacctctgagagag

SEQ ID NO: 115689 - DNA, 25 bp, mus musculus
gatgtgacctctgagagaggatgga

SEQ ID NO: 115690 - DNA, 25 bp, mus musculus
gactgaaatacccagtcactcccgt

SEQ ID NO: 115691 - DNA, 25 bp, mus musculus
agctgcctagcagacagtgattcct

SEQ ID NO: 115692 - DNA, 25 bp, mus musculus
aagctgcgtcggggcgcacaggtta

SEQ ID NO: 115693 - DNA, 25 bp, mus musculus
aatggctactccacagtcagttttc

SEQ ID NO: 115694 - DNA, 25 bp, mus musculus
ggcctgtagtcgctactatgatatc

SEQ ID NO: 115695 - DNA, 25 bp, mus musculus
ctgtagtcgctactatgatatctta

SEQ ID NO: 115696 - DNA, 25 bp, mus musculus
tagtcgctactatgatatcttaggt

SEQ ID NO: 115697 - DNA, 25 bp, mus musculus
tgatatcttaggtgtgcctaagtct

SEQ ID NO: 115698 - DNA, 25 bp, mus musculus
cttaggtgtgcctaagtctgcctca

SEQ ID NO: 115699 - DNA, 25 bp, mus musculus
taagtctgcctcagagcgacaaatc

SEQ ID NO: 115700 - DNA, 25 bp, mus musculus
gtctgcctcagagcgacaaatcaaa

SEQ ID NO: 115701 - DNA, 25 bp, mus musculus
tgcctcagagcgacaaatcaaaaag

SEQ ID NO: 115702 - DNA, 25 bp, mus musculus
aaaggcctttcacaaattagccatg

SEQ ID NO: 115703 - DNA, 25 bp, mus musculus
ctttcacaaattagccatgaagtac

SEQ ID NO: 115704 - DNA, 25 bp, mus musculus
tactccacagtcagttttcgtcttt

SEQ ID NO: 115705 - DNA, 25 bp, mus musculus
tccacagtcagttttcgtctttgca

SEQ ID NO: 115706 - DNA, 25 bp, mus musculus
acagtcagttttcgtctttgcaatc

SEQ ID NO: 115707 - DNA, 25 bp, mus musculus
agttttcgtctttgcaatctgcatt

SEQ ID NO: 115708 - DNA, 25 bp, mus musculus
cgtctttgcaatctgcattttaatg

SEQ ID NO: 115709 - DNA, 25 bp, mus musculus
agaattaatcctggcctgtagtcgc

SEQ ID NO: 115710 - DNA, 25 bp, mus musculus
attaatcctggcctgtagtcgctac

SEQ ID NO: 115711 - DNA, 25 bp, mus musculus
aatcctggcctgtagtcgctactat

SEQ ID NO: 115712 - DNA, 25 bp, mus musculus
tacagtcacagcatcattacgaacc

SEQ ID NO: 115713 - DNA, 25 bp, mus musculus
cacagcatcattacgaacctccttt

SEQ ID NO: 115714 - DNA, 25 bp, mus musculus
catcttggccacttcagcaagttca

SEQ ID NO: 115715 - DNA, 25 bp, mus musculus
ggccacttcagcaagttcattcccg

SEQ ID NO: 115716 - DNA, 25 bp, mus musculus
ttcagcaagttcattcccgagggat

SEQ ID NO: 115717 - DNA, 25 bp, mus musculus
agtgatcctgacctgggcttcctgg

SEQ ID NO: 115718 - DNA, 25 bp, mus musculus
ttcctggagaccgtgtcacctggct

SEQ ID NO: 115719 - DNA, 25 bp, mus musculus
gagaccgtgtcacctggctactcca

SEQ ID NO: 115720 - DNA, 25 bp, mus musculus
cgtcgccagtgatggaactgacacc

SEQ ID NO: 115721 - DNA, 25 bp, mus musculus
tggaactgacacctgagcaggcacc

SEQ ID NO: 115722 - DNA, 25 bp, mus musculus
ctgagcaggcacctgggcttagcat

SEQ ID NO: 115723 - DNA, 25 bp, mus musculus
aggcacctgggcttagcatggacat

SEQ ID NO: 115724 - DNA, 25 bp, mus musculus
taccacgtaactggatggacggact

SEQ ID NO: 115725 - DNA, 25 bp, mus musculus
cttgccctgaatcctgaaggagggc

SEQ ID NO: 115726 - DNA, 25 bp, mus musculus
tgggtccgcaactttgtcgatagcc

SEQ ID NO: 115727 - DNA, 25 bp, mus musculus
cgcaactttgtcgatagccccatta

SEQ ID NO: 115728 - DNA, 25 bp, mus musculus
gatagccccattattgtcgacatcc

SEQ ID NO: 115729 - DNA, 25 bp, mus musculus
cccattattgtcgacatccccaaag

SEQ ID NO: 115730 - DNA, 25 bp, mus musculus
attgtcgacatccccaaagacgcat

SEQ ID NO: 115731 - DNA, 25 bp, mus musculus
gacatccccaaagacgcattttaca

SEQ ID NO: 115732 - DNA, 25 bp, mus musculus
tggagctctaagcttctagatcatt

SEQ ID NO: 115733 - DNA, 25 bp, mus musculus
agctctaagcttctagatcattctc

SEQ ID NO: 115734 - DNA, 25 bp, mus musculus
taaacagcagtgttcccaaactggg

SEQ ID NO: 115735 - DNA, 25 bp, mus musculus
gttcttatatcccttgctctggtca

SEQ ID NO: 115736 - DNA, 25 bp, mus musculus
cttatatcccttgctctggtcaacc

SEQ ID NO: 115737 - DNA, 25 bp, mus musculus
atatcccttgctctggtcaaccagg

SEQ ID NO: 115738 - DNA, 25 bp, mus musculus
cttgctctggtcaaccaggttgcag

SEQ ID NO: 115739 - DNA, 25 bp, mus musculus
tttcctgtcctcacaggaacgaagt

SEQ ID NO: 115740 - DNA, 25 bp, mus musculus
cacctgtcactatagccaagcttgc

SEQ ID NO: 115741 - DNA, 25 bp, mus musculus
ctgtcactatagccaagcttgcgga

SEQ ID NO: 115742 - DNA, 25 bp, mus musculus
ctatagccaagcttgcggataataa

SEQ ID NO: 115743 - DNA, 25 bp, mus musculus
tagccaagcttgcggataataaagt

SEQ ID NO: 115744 - DNA, 25 bp, mus musculus
cttctagatcattctctccacttcc

SEQ ID NO: 115745 - DNA, 25 bp, mus musculus
ctagatcattctctccacttccgag

SEQ ID NO: 115746 - DNA, 25 bp, mus musculus
aagtattgattcctgctgctgctcc

SEQ ID NO: 115747 - DNA, 25 bp, mus musculus
tattgattcctgctgctgctccagg

SEQ ID NO: 115748 - DNA, 25 bp, mus musculus
ctgctgctccaggcacccagttctg

SEQ ID NO: 115749 - DNA, 25 bp, mus musculus
aatcagtgagccctgccgtgctgag

SEQ ID NO: 115750 - DNA, 25 bp, mus musculus
cagtgagccctgccgtgctgaggca

SEQ ID NO: 115751 - DNA, 25 bp, mus musculus
ccgtgctgaggcaccatctcagggg

SEQ ID NO: 115752 - DNA, 25 bp, mus musculus
gcctcttccttcaggacctgcctgg

SEQ ID NO: 115753 - DNA, 25 bp, mus musculus
tcttccttcaggacctgcctggagc

SEQ ID NO: 115754 - DNA, 25 bp, mus musculus
cactgcattgtttccaagtcttagg

SEQ ID NO: 115755 - DNA, 25 bp, mus musculus
tgcattgtttccaagtcttagggat

SEQ ID NO: 115756 - DNA, 25 bp, mus musculus
ataagccatggtgttttgaatgggt

SEQ ID NO: 115757 - DNA, 25 bp, mus musculus
tcaataagtattcatcccttatagg

SEQ ID NO: 115758 - DNA, 25 bp, mus musculus
ataagtattcatcccttataggtgt

SEQ ID NO: 115759 - DNA, 25 bp, mus musculus
agtattcatcccttataggtgtgta

SEQ ID NO: 115760 - DNA, 25 bp, mus musculus
attcatcccttataggtgtgtagtg

SEQ ID NO: 115761 - DNA, 25 bp, mus musculus
catcccttataggtgtgtagtgttt

SEQ ID NO: 115762 - DNA, 25 bp, mus musculus
gtttggtccttgtgtactgtgatta

SEQ ID NO: 115763 - DNA, 25 bp, mus musculus
tggtccttgtgtactgtgattactc

SEQ ID NO: 115764 - DNA, 25 bp, mus musculus
tccttcaggacctgcctggagcctg

SEQ ID NO: 115765 - DNA, 25 bp, mus musculus
ttcaggacctgcctggagcctgctg

SEQ ID NO: 115766 - DNA, 25 bp, mus musculus
tgcctggagcctgctgcttctattt

SEQ ID NO: 115767 - DNA, 25 bp, mus musculus
tttttatagaacactcactgcattg

SEQ ID NO: 115768 - DNA, 25 bp, mus musculus
ttatagaacactcactgcattgttt

SEQ ID NO: 115769 - DNA, 25 bp, mus musculus
tagaacactcactgcattgtttcca

SEQ ID NO: 115770 - DNA, 25 bp, mus musculus
aacactcactgcattgtttccaagt

SEQ ID NO: 115771 - DNA, 25 bp, mus musculus
actcactgcattgtttccaagtctt

SEQ ID NO: 115772 - DNA, 25 bp, mus musculus
tctcaggctataccctgaggtcacc

SEQ ID NO: 115773 - DNA, 25 bp, mus musculus
caggctataccctgaggtcacccac

SEQ ID NO: 115774 - DNA, 25 bp, mus musculus
aatttcagtccattgaactgattgt

SEQ ID NO: 115775 - DNA, 25 bp, mus musculus
ttcagtccattgaactgattgtagg

SEQ ID NO: 115776 - DNA, 25 bp, mus musculus
tttcagaaattctggctggatgtgg

SEQ ID NO: 115777 - DNA, 25 bp, mus musculus
gtacatgcctagcatcccaacatct

SEQ ID NO: 115778 - DNA, 25 bp, mus musculus
catgcctagcatcccaacatctggg

SEQ ID NO: 115779 - DNA, 25 bp, mus musculus
ttgcaagttccaggccagcctggct

SEQ ID NO: 115780 - DNA, 25 bp, mus musculus
gttccaggccagcctggctagccta

SEQ ID NO: 115781 - DNA, 25 bp, mus musculus
cagcctggctagcctacatagtgag

SEQ ID NO: 115782 - DNA, 25 bp, mus musculus
cctggctagcctacatagtgagatc

SEQ ID NO: 115783 - DNA, 25 bp, mus musculus
ggctagcctacatagtgagatccaa

SEQ ID NO: 115784 - DNA, 25 bp, mus musculus
ccactctcacactctaaggttcaga

SEQ ID NO: 115785 - DNA, 25 bp, mus musculus
ctctcacactctaaggttcagatag

SEQ ID NO: 115786 - DNA, 25 bp, mus musculus
atagatactgcttacagcccaatgg

SEQ ID NO: 115787 - DNA, 25 bp, mus musculus
gatactgcttacagcccaatggtca

SEQ ID NO: 115788 - DNA, 25 bp, mus musculus
gcttacagcccaatggtcaccattc

SEQ ID NO: 115789 - DNA, 25 bp, mus musculus
tacagcccaatggtcaccattcgtc

SEQ ID NO: 115790 - DNA, 25 bp, mus musculus
atggtcaccattcgtctttcatata

SEQ ID NO: 115791 - DNA, 25 bp, mus musculus
gtcaccattcgtctttcatataatt

SEQ ID NO: 115792 - DNA, 25 bp, mus musculus
gactcacatatgcgggataaactcc

SEQ ID NO: 115793 - DNA, 25 bp, mus musculus
ccccatatttcctgtatcaaagcta

SEQ ID NO: 115794 - DNA, 25 bp, mus musculus
agtatgtctacatcaactacctttt

SEQ ID NO: 115795 - DNA, 25 bp, mus musculus
atgtctacatcaactaccttttctt

SEQ ID NO: 115796 - DNA, 25 bp, mus musculus
tctacatcaactaccttttcttcag

SEQ ID NO: 115797 - DNA, 25 bp, mus musculus
tcaactaccttttcttcagccaagt

SEQ ID NO: 115798 - DNA, 25 bp, mus musculus
tcttcagccaagtacctcggcgtaa

SEQ ID NO: 115799 - DNA, 25 bp, mus musculus
tcagccaagtacctcggcgtaatca

SEQ ID NO: 115800 - DNA, 25 bp, mus musculus
gccaagtacctcggcgtaatcacag

SEQ ID NO: 115801 - DNA, 25 bp, mus musculus
tacctcggcgtaatcacagaagatg

SEQ ID NO: 115802 - DNA, 25 bp, mus musculus
ttgttgcccgataccgctaccaaga

SEQ ID NO: 115803 - DNA, 25 bp, mus musculus
gataccgctaccaagaagtggtggt

SEQ ID NO: 115804 - DNA, 25 bp, mus musculus
atttcctgtatcaaagctattgaca

SEQ ID NO: 115805 - DNA, 25 bp, mus musculus
aaagctattgacatctacatccttg

SEQ ID NO: 115806 - DNA, 25 bp, mus musculus
gctattgacatctacatccttgtat

SEQ ID NO: 115807 - DNA, 25 bp, mus musculus
attgacatctacatccttgtatgcc

SEQ ID NO: 115808 - DNA, 25 bp, mus musculus
atctacatccttgtatgcctattct

SEQ ID NO: 115809 - DNA, 25 bp, mus musculus
ttcgttttccctgtcgactgctgga

SEQ ID NO: 115810 - DNA, 25 bp, mus musculus
gttttccctgtcgactgctggagta

SEQ ID NO: 115811 - DNA, 25 bp, mus musculus
ttccctgtcgactgctggagtatgt

SEQ ID NO: 115812 - DNA, 25 bp, mus musculus
aaagctgtcaactatggaaggtgtg

SEQ ID NO: 115813 - DNA, 25 bp, mus musculus
aagctgtcaactatggaaggtgtga

SEQ ID NO: 115814 - DNA, 25 bp, mus musculus
gtattggaccacacagttttgaaga

SEQ ID NO: 115815 - DNA, 25 bp, mus musculus
tattggaccacacagttttgaagat

SEQ ID NO: 115816 - DNA, 25 bp, mus musculus
attggaccacacagttttgaagatg

SEQ ID NO: 115817 - DNA, 25 bp, mus musculus
ttggaccacacagttttgaagatga

SEQ ID NO: 115818 - DNA, 25 bp, mus musculus
tggaccacacagttttgaagatgaa

SEQ ID NO: 115819 - DNA, 25 bp, mus musculus
ggaccacacagttttgaagatgaag

SEQ ID NO: 115820 - DNA, 25 bp, mus musculus
gagatgacaactcggcttcgctcgg

SEQ ID NO: 115821 - DNA, 25 bp, mus musculus
agatgacaactcggcttcgctcgga

SEQ ID NO: 115822 - DNA, 25 bp, mus musculus
gatgacaactcggcttcgctcggac

SEQ ID NO: 115823 - DNA, 25 bp, mus musculus
atgacaactcggcttcgctcggact

SEQ ID NO: 115824 - DNA, 25 bp, mus musculus
tgacaactcggcttcgctcggactc

SEQ ID NO: 115825 - DNA, 25 bp, mus musculus
gacaactcggcttcgctcggactcg

SEQ ID NO: 115826 - DNA, 25 bp, mus musculus
acaactcggcttcgctcggactcgg

SEQ ID NO: 115827 - DNA, 25 bp, mus musculus
caactcggcttcgctcggactcggg

SEQ ID NO: 115828 - DNA, 25 bp, mus musculus
tggccagacctgaccggccttctct

SEQ ID NO: 115829 - DNA, 25 bp, mus musculus
cctcacgcattgtgccacgtctgct

SEQ ID NO: 115830 - DNA, 25 bp, mus musculus
gttgtaatcgtcactaacacttctt

SEQ ID NO: 115831 - DNA, 25 bp, mus musculus
atcgtcactaacacttcttcttctc

SEQ ID NO: 115832 - DNA, 25 bp, mus musculus
gtcactaacacttcttcttctctga

SEQ ID NO: 115833 - DNA, 25 bp, mus musculus
tcttctctgaccccttgatactcta

SEQ ID NO: 115834 - DNA, 25 bp, mus musculus
agttggcttttcttctacaaagatg

SEQ ID NO: 115835 - DNA, 25 bp, mus musculus
tggcttttcttctacaaagatgttg

SEQ ID NO: 115836 - DNA, 25 bp, mus musculus
ggaccttctgtggagatggtgcctt

SEQ ID NO: 115837 - DNA, 25 bp, mus musculus
ggtcctggacgctgagcagacagaa

SEQ ID NO: 115838 - DNA, 25 bp, mus musculus
cctggacgctgagcagacagaacgg

SEQ ID NO: 115839 - DNA, 25 bp, mus musculus
attaaaagtggcgcagctgtcacat

SEQ ID NO: 115840 - DNA, 25 bp, mus musculus
gcattgtgccacgtctgcttctcca

SEQ ID NO: 115841 - DNA, 25 bp, mus musculus
ttgtgccacgtctgcttctccaacc

SEQ ID NO: 115842 - DNA, 25 bp, mus musculus
gctccatcctgtgcctcagtcactg

SEQ ID NO: 115843 - DNA, 25 bp, mus musculus
ccatcctgtgcctcagtcactgcag

SEQ ID NO: 115844 - DNA, 25 bp, mus musculus
gcctcagtcactgcagctggatgtg

SEQ ID NO: 115845 - DNA, 25 bp, mus musculus
gtcactgcagctggatgtgttcctg

SEQ ID NO: 115846 - DNA, 25 bp, mus musculus
ggatgtgttcctgttgtaatcgtca

SEQ ID NO: 115847 - DNA, 25 bp, mus musculus
gttcctgttgtaatcgtcactaaca

SEQ ID NO: 115848 - DNA, 25 bp, mus musculus
tccctgctgctggtgacgctggacc

SEQ ID NO: 115849 - DNA, 25 bp, mus musculus
ctgctgctggtgacgctggacccac

SEQ ID NO: 115850 - DNA, 25 bp, mus musculus
ttctgccagggcacgtgcgcactac

SEQ ID NO: 115851 - DNA, 25 bp, mus musculus
acgtgcgcactacccgaaacgctga

SEQ ID NO: 115852 - DNA, 25 bp, mus musculus
tgcgcactacccgaaacgctgaggg

SEQ ID NO: 115853 - DNA, 25 bp, mus musculus
gcactcaaccacgctgtgctgcgcg

SEQ ID NO: 115854 - DNA, 25 bp, mus musculus
gagcgtctatcacccatctccgtgc

SEQ ID NO: 115855 - DNA, 25 bp, mus musculus
atctccgtgctcttcttcgacaata

SEQ ID NO: 115856 - DNA, 25 bp, mus musculus
tccgtgctcttcttcgacaatagtg

SEQ ID NO: 115857 - DNA, 25 bp, mus musculus
ctcttcttcgacaatagtgacaacg

SEQ ID NO: 115858 - DNA, 25 bp, mus musculus
ttcttcgacaatagtgacaacgtgg

SEQ ID NO: 115859 - DNA, 25 bp, mus musculus
ctgcgacactacgaagacatggtgg

SEQ ID NO: 115860 - DNA, 25 bp, mus musculus
cacacggagcccagggtagaagttg

SEQ ID NO: 115861 - DNA, 25 bp, mus musculus
gttggtccagtgggcacttgtcgta

SEQ ID NO: 115862 - DNA, 25 bp, mus musculus
acttgtcgtacccgacggttgcatg

SEQ ID NO: 115863 - DNA, 25 bp, mus musculus
cgtggcttcctagccaacttctgcc

SEQ ID NO: 115864 - DNA, 25 bp, mus musculus
ggcttcctagccaacttctgccagg

SEQ ID NO: 115865 - DNA, 25 bp, mus musculus
ttcctagccaacttctgccagggca

SEQ ID NO: 115866 - DNA, 25 bp, mus musculus
ctagccaacttctgccagggcacgt

SEQ ID NO: 115867 - DNA, 25 bp, mus musculus
aacttctgccagggcacgtgcgcac

SEQ ID NO: 115868 - DNA, 25 bp, mus musculus
aggatcggacgctttgtgatcgaag

SEQ ID NO: 115869 - DNA, 25 bp, mus musculus
gaagacctggctactgatgacgtca

SEQ ID NO: 115870 - DNA, 25 bp, mus musculus
gatcctttggaccgggccttggctg

SEQ ID NO: 115871 - DNA, 25 bp, mus musculus
ttggctgagctggctgcctgagtaa

SEQ ID NO: 115872 - DNA, 25 bp, mus musculus
aggaccaagccatcaatgtcaccaa

SEQ ID NO: 115873 - DNA, 25 bp, mus musculus
aagccatcaatgtcaccaatcagtg

SEQ ID NO: 115874 - DNA, 25 bp, mus musculus
tcaatgtcaccaatcagtgcctttg

SEQ ID NO: 115875 - DNA, 25 bp, mus musculus
tcaccaatcagtgcctttgagggtt

SEQ ID NO: 115876 - DNA, 25 bp, mus musculus
tgtccatctcccaaagacatcatat

SEQ ID NO: 115877 - DNA, 25 bp, mus musculus
tctcccaaagacatcatatggcaag

SEQ ID NO: 115878 - DNA, 25 bp, mus musculus
agaattgcttcaaatgtctgtactt

SEQ ID NO: 115879 - DNA, 25 bp, mus musculus
gcttcaaatgtctgtactttggaaa

SEQ ID NO: 115880 - DNA, 25 bp, mus musculus
actgatgacgtcatgctcctggaca

SEQ ID NO: 115881 - DNA, 25 bp, mus musculus
ctggacacctgggaccaggtctttg

SEQ ID NO: 115882 - DNA, 25 bp, mus musculus
acggaagccttgacttctgctaagc

SEQ ID NO: 115883 - DNA, 25 bp, mus musculus
acttctgctaagcggtacatcgaga

SEQ ID NO: 115884 - DNA, 25 bp, mus musculus
atcgagacagatccagcaaatcggg

SEQ ID NO: 115885 - DNA, 25 bp, mus musculus
acagtcgttaggcagggctttgagc

SEQ ID NO: 115886 - DNA, 25 bp, mus musculus
tccttcgtgggctggttcctcggct

SEQ ID NO: 115887 - DNA, 25 bp, mus musculus
tggttcctcggctgggacaacaact

SEQ ID NO: 115888 - DNA, 25 bp, mus musculus
ctctgaatcctatcaatcaaggaaa

SEQ ID NO: 115889 - DNA, 25 bp, mus musculus
cgttctctggaagacactgaaacag

SEQ ID NO: 115890 - DNA, 25 bp, mus musculus
tgctctatgcatatacgtaatgtca

SEQ ID NO: 115891 - DNA, 25 bp, mus musculus
acctatttagtatcatcctatttga

SEQ ID NO: 115892 - DNA, 25 bp, mus musculus
ttagtatcatcctatttgagagttt

SEQ ID NO: 115893 - DNA, 25 bp, mus musculus
actgaaacactgttctgttcaagca

SEQ ID NO: 115894 - DNA, 25 bp, mus musculus
tcaagcacctggtgctatgccttca

SEQ ID NO: 115895 - DNA, 25 bp, mus musculus
acctggtgctatgccttcatattag

SEQ ID NO: 115896 - DNA, 25 bp, mus musculus
tgctatgccttcatattagagcacc

SEQ ID NO: 115897 - DNA, 25 bp, mus musculus
atattagagcaccttctctgaggct

SEQ ID NO: 115898 - DNA, 25 bp, mus musculus
gagcaccttctctgaggctgattgg

SEQ ID NO: 115899 - DNA, 25 bp, mus musculus
cttctctgaggctgattggtgggca

SEQ ID NO: 115900 - DNA, 25 bp, mus musculus
atgtgtctcagttgtgaaggtctat

SEQ ID NO: 115901 - DNA, 25 bp, mus musculus
ggtctattcctggctgcacagtccc

SEQ ID NO: 115902 - DNA, 25 bp, mus musculus
ctgctctcagccctggaagaatcca

SEQ ID NO: 115903 - DNA, 25 bp, mus musculus
atccccacaatgactagctgttgct

SEQ ID NO: 115904 - DNA, 25 bp, mus musculus
actagctgttgctctccaagctaag

SEQ ID NO: 115905 - DNA, 25 bp, mus musculus
tgttgctctccaagctaagggacca

SEQ ID NO: 115906 - DNA, 25 bp, mus musculus
agctaagggaccattccctgctcta

SEQ ID NO: 115907 - DNA, 25 bp, mus musculus
gggaccattccctgctctatgcata

SEQ ID NO: 115908 - DNA, 25 bp, mus musculus
tggcacagagggtccctcagcaagt

SEQ ID NO: 115909 - DNA, 25 bp, mus musculus
tccctcagcaagtgcctaaagaatg

SEQ ID NO: 115910 - DNA, 25 bp, mus musculus
tctcttccctactgtcttcagtggg

SEQ ID NO: 115911 - DNA, 25 bp, mus musculus
tccctttgtcatcatgtgaagactt

SEQ ID NO: 115912 - DNA, 25 bp, mus musculus
gcgtcgaacgccatatgtcacctgt

SEQ ID NO: 115913 - DNA, 25 bp, mus musculus
aacgccatatgtcacctgtgccact

SEQ ID NO: 115914 - DNA, 25 bp, mus musculus
cacctgtgccactgtccatgtcatc

SEQ ID NO: 115915 - DNA, 25 bp, mus musculus
tgtccatgtcatccagcagtggccc

SEQ ID NO: 115916 - DNA, 25 bp, mus musculus
tgtcatccagcagtggccccaggtg

SEQ ID NO: 115917 - DNA, 25 bp, mus musculus
gtttgcctcaactcagtccctctaa

SEQ ID NO: 115918 - DNA, 25 bp, mus musculus
ctcaactcagtccctctaacatgca

SEQ ID NO: 115919 - DNA, 25 bp, mus musculus
cctctaacatgcattttctggcaaa

SEQ ID NO: 115920 - DNA, 25 bp, mus musculus
aattggcctggtatccaaaacatct

SEQ ID NO: 115921 - DNA, 25 bp, mus musculus
cctggtatccaaaacatctcgaggc

SEQ ID NO: 115922 - DNA, 25 bp, mus musculus
tgggtgctttcaggggcatttgctg

SEQ ID NO: 115923 - DNA, 25 bp, mus musculus
ctttcaggggcatttgctgaccacc

SEQ ID NO: 115924 - DNA, 25 bp, mus musculus
cctctgtgtccccacatttgcagtt

SEQ ID NO: 115925 - DNA, 25 bp, mus musculus
catcataggtcaccttgatgcaggc

SEQ ID NO: 115926 - DNA, 25 bp, mus musculus
gtgtggccctccatcttgtctcttc

SEQ ID NO: 115927 - DNA, 25 bp, mus musculus
atcttgtctcttccctactgtcttc

SEQ ID NO: 115928 - DNA, 25 bp, mus musculus
catgcctggctttgccccttgacca

SEQ ID NO: 115929 - DNA, 25 bp, mus musculus
tgcctggctttgccccttgaccagc

SEQ ID NO: 115930 - DNA, 25 bp, mus musculus
ccaagacatgggcgctacttgactg

SEQ ID NO: 115931 - DNA, 25 bp, mus musculus
aagacatgggcgctacttgactgtg

SEQ ID NO: 115932 - DNA, 25 bp, mus musculus
tgggcgctacttgactgtggctgcc

SEQ ID NO: 115933 - DNA, 25 bp, mus musculus
tacttgactgtggctgccgtgttca

SEQ ID NO: 115934 - DNA, 25 bp, mus musculus
acttgactgtggctgccgtgttcag

SEQ ID NO: 115935 - DNA, 25 bp, mus musculus
ttgactgtggctgccgtgttcaggg

SEQ ID NO: 115936 - DNA, 25 bp, mus musculus
tgttcaggggccgcatgtctatgaa

SEQ ID NO: 115937 - DNA, 25 bp, mus musculus
gttcaggggccgcatgtctatgaag

SEQ ID NO: 115938 - DNA, 25 bp, mus musculus
tgcttaatgtccaaaacaagaacag

SEQ ID NO: 115939 - DNA, 25 bp, mus musculus
aatgtccaaaacaagaacagcagct

SEQ ID NO: 115940 - DNA, 25 bp, mus musculus
gctgcctgtgatccaagacatgggc

SEQ ID NO: 115941 - DNA, 25 bp, mus musculus
tgcctgtgatccaagacatgggcgc

SEQ ID NO: 115942 - DNA, 25 bp, mus musculus
gcctgtgatccaagacatgggcgct

SEQ ID NO: 115943 - DNA, 25 bp, mus musculus
cctgtgatccaagacatgggcgcta

SEQ ID NO: 115944 - DNA, 25 bp, mus musculus
tgtgatccaagacatgggcgctact

SEQ ID NO: 115945 - DNA, 25 bp, mus musculus
tgatccaagacatgggcgctacttg

SEQ ID NO: 115946 - DNA, 25 bp, mus musculus
atccaagacatgggcgctacttgac

SEQ ID NO: 115947 - DNA, 25 bp, mus musculus
tccaagacatgggcgctacttgact

SEQ ID NO: 115948 - DNA, 25 bp, mus musculus
cgatgccctgggccccgatggtcag

SEQ ID NO: 115949 - DNA, 25 bp, mus musculus
tgggccccgatggtcagctgctcca

SEQ ID NO: 115950 - DNA, 25 bp, mus musculus
caatgcctctgtcatcttcagcctc

SEQ ID NO: 115951 - DNA, 25 bp, mus musculus
atgcctctgtcatcttcagcctctc

SEQ ID NO: 115952 - DNA, 25 bp, mus musculus
ctctgtcatcttcagcctctcgaag

SEQ ID NO: 115953 - DNA, 25 bp, mus musculus
ctgtcatcttcagcctctcgaaggg

SEQ ID NO: 115954 - DNA, 25 bp, mus musculus
gtcatcttcagcctctcgaagggaa

SEQ ID NO: 115955 - DNA, 25 bp, mus musculus
catcttcagcctctcgaagggaaac

SEQ ID NO: 115956 - DNA, 25 bp, mus musculus
ttcagcctctcgaagggaaacagca

SEQ ID NO: 115957 - DNA, 25 bp, mus musculus
cagcctctcgaagggaaacagcatg

SEQ ID NO: 115958 - DNA, 25 bp, mus musculus
atgcaagaggccctgagattcgggt

SEQ ID NO: 115959 - DNA, 25 bp, mus musculus
ccctgagattcgggtgccaggtggc

SEQ ID NO: 115960 - DNA, 25 bp, mus musculus
gatggtcagctgctccactcagatg

SEQ ID NO: 115961 - DNA, 25 bp, mus musculus
tggtcagctgctccactcagatgcc

SEQ ID NO: 115962 - DNA, 25 bp, mus musculus
gtcagctgctccactcagatgcctt

SEQ ID NO: 115963 - DNA, 25 bp, mus musculus
tggagacaccttcaatgcctctgtc

SEQ ID NO: 115964 - DNA, 25 bp, mus musculus
gacaccttcaatgcctctgtcatct

SEQ ID NO: 115965 - DNA, 25 bp, mus musculus
caccttcaatgcctctgtcatcttc

SEQ ID NO: 115966 - DNA, 25 bp, mus musculus
ccttcaatgcctctgtcatcttcag

SEQ ID NO: 115967 - DNA, 25 bp, mus musculus
ttcaatgcctctgtcatcttcagcc

SEQ ID NO: 115968 - DNA, 25 bp, mus musculus
gtttttgtcaccaagctcaagagag

SEQ ID NO: 115969 - DNA, 25 bp, mus musculus
gtcaccaagctcaagagagaggtct

SEQ ID NO: 115970 - DNA, 25 bp, mus musculus
acctcaagcacttctgtaggagtga

SEQ ID NO: 115971 - DNA, 25 bp, mus musculus
agcacttctgtaggagtgaccagtg

SEQ ID NO: 115972 - DNA, 25 bp, mus musculus
aactagtgtgactcggactgtgatg

SEQ ID NO: 115973 - DNA, 25 bp, mus musculus
tagtgtgactcggactgtgatgcct

SEQ ID NO: 115974 - DNA, 25 bp, mus musculus
gttatggtattccctttgatgaata

SEQ ID NO: 115975 - DNA, 25 bp, mus musculus
atggtattccctttgatgaatacta

SEQ ID NO: 115976 - DNA, 25 bp, mus musculus
gatccatttttccctctctgtgaat

SEQ ID NO: 115977 - DNA, 25 bp, mus musculus
tttttccctctctgtgaatccagat

SEQ ID NO: 115978 - DNA, 25 bp, mus musculus
gaatccagattcaacactttcaatg

SEQ ID NO: 115979 - DNA, 25 bp, mus musculus
tccagattcaacactttcaatgtat

SEQ ID NO: 115980 - DNA, 25 bp, mus musculus
aacctggatcggaaccaaatgagat

SEQ ID NO: 115981 - DNA, 25 bp, mus musculus
tttaaaactgcatctgccctaaggt

SEQ ID NO: 115982 - DNA, 25 bp, mus musculus
actgcatctgccctaaggtcttcag

SEQ ID NO: 115983 - DNA, 25 bp, mus musculus
tctgccctaaggtcttcagcacctt

SEQ ID NO: 115984 - DNA, 25 bp, mus musculus
tcagcacctttgaatgtgaagttga

SEQ ID NO: 115985 - DNA, 25 bp, mus musculus
ttgacccgtaaatctgaagctaatg

SEQ ID NO: 115986 - DNA, 25 bp, mus musculus
gaagctaatgcatccactacctttt

SEQ ID NO: 115987 - DNA, 25 bp, mus musculus
gctaatgcatccactaccttttcca

SEQ ID NO: 115988 - DNA, 25 bp, mus musculus
taatgttacacatggcagtactcat

SEQ ID NO: 115989 - DNA, 25 bp, mus musculus
gttacacatggcagtactcatgttc

SEQ ID NO: 115990 - DNA, 25 bp, mus musculus
tgctcctgttaggcagggcctctgg

SEQ ID NO: 115991 - DNA, 25 bp, mus musculus
ctcctgttaggcagggcctctggga

SEQ ID NO: 115992 - DNA, 25 bp, mus musculus
cctgttaggcagggcctctgggaag

SEQ ID NO: 115993 - DNA, 25 bp, mus musculus
gcatatccttgccttcctttggaat

SEQ ID NO: 115994 - DNA, 25 bp, mus musculus
gaattttgcacttagccatggtcgg

SEQ ID NO: 115995 - DNA, 25 bp, mus musculus
attttgcacttagccatggtcgggt

SEQ ID NO: 115996 - DNA, 25 bp, mus musculus
tgcacttagccatggtcgggttgga

SEQ ID NO: 115997 - DNA, 25 bp, mus musculus
cttagccatggtcgggttggaagca

SEQ ID NO: 115998 - DNA, 25 bp, mus musculus
tagccatggtcgggttggaagcaaa

SEQ ID NO: 115999 - DNA, 25 bp, mus musculus
gccatggtcgggttggaagcaaagc

SEQ ID NO: 116000 - DNA, 25 bp, mus musculus
cacatggcagtactcatgttcccct

SEQ ID NO: 116001 - DNA, 25 bp, mus musculus
tggcagtactcatgttccccttgat

SEQ ID NO: 116002 - DNA, 25 bp, mus musculus
gcagtactcatgttccccttgattc

SEQ ID NO: 116003 - DNA, 25 bp, mus musculus
tactcatgttccccttgattcccag

SEQ ID NO: 116004 - DNA, 25 bp, mus musculus
agctgagtcctgactctgtgctcct

SEQ ID NO: 116005 - DNA, 25 bp, mus musculus
cctgactctgtgctcctgttaggca

SEQ ID NO: 116006 - DNA, 25 bp, mus musculus
actctgtgctcctgttaggcagggc

SEQ ID NO: 116007 - DNA, 25 bp, mus musculus
tctgtgctcctgttaggcagggcct

SEQ ID NO: 116008 - DNA, 25 bp, mus musculus
tctagacttccaggcccatggtaca

SEQ ID NO: 116009 - DNA, 25 bp, mus musculus
cttccaggcccatggtacaatccct

SEQ ID NO: 116010 - DNA, 25 bp, mus musculus
gtgccgagcctccaatcctgttgag

SEQ ID NO: 116011 - DNA, 25 bp, mus musculus
agcctccaatcctgttgagagtggg

SEQ ID NO: 116012 - DNA, 25 bp, mus musculus
caatcctgttgagagtgggtgccgg

SEQ ID NO: 116013 - DNA, 25 bp, mus musculus
gggcatcgactccaaacactggaac

SEQ ID NO: 116014 - DNA, 25 bp, mus musculus
cgactccaaacactggaactcatac

SEQ ID NO: 116015 - DNA, 25 bp, mus musculus
caaacactggaactcatactgcacc

SEQ ID NO: 116016 - DNA, 25 bp, mus musculus
cacgactcacaccttcgtcaaggcg

SEQ ID NO: 116017 - DNA, 25 bp, mus musculus
tcacaccttcgtcaaggcgttgaca

SEQ ID NO: 116018 - DNA, 25 bp, mus musculus
tgcctggaggttcatccggatagac

SEQ ID NO: 116019 - DNA, 25 bp, mus musculus
gtgtgtgctcagcaggaaggctaca

SEQ ID NO: 116020 - DNA, 25 bp, mus musculus
tggtacaatccctttcaacaggact

SEQ ID NO: 116021 - DNA, 25 bp, mus musculus
tttcaacaggactcaccggagcaag

SEQ ID NO: 116022 - DNA, 25 bp, mus musculus
caggactcaccggagcaagcgctca

SEQ ID NO: 116023 - DNA, 25 bp, mus musculus
agataagaccacagccacagacatc

SEQ ID NO: 116024 - DNA, 25 bp, mus musculus
agccacagacatcaagggcaaggag

SEQ ID NO: 116025 - DNA, 25 bp, mus musculus
agacatcaagggcaaggaggtgaca

SEQ ID NO: 116026 - DNA, 25 bp, mus musculus
agtgctggccgaggtgaacattaac

SEQ ID NO: 116027 - DNA, 25 bp, mus musculus
ttttgagaccaagtgccgagcctcc

SEQ ID NO: 116028 - DNA, 25 bp, mus musculus
gcctacattcccgagggacagcgct

SEQ ID NO: 116029 - DNA, 25 bp, mus musculus
cagcgctattccattcagaatgccc

SEQ ID NO: 116030 - DNA, 25 bp, mus musculus
ttcggcacctcggaccgtgtctatg

SEQ ID NO: 116031 - DNA, 25 bp, mus musculus
agcccccgtgttgggcagatcctca

SEQ ID NO: 116032 - DNA, 25 bp, mus musculus
aagcaaacctatgacaagtttgacg

SEQ ID NO: 116033 - DNA, 25 bp, mus musculus
tttgacgccaacatgcgcagcgacg

SEQ ID NO: 116034 - DNA, 25 bp, mus musculus
agcgacgacgcgctgctcaaaaact

SEQ ID NO: 116035 - DNA, 25 bp, mus musculus
gacgcgctgctcaaaaactatgggc

SEQ ID NO: 116036 - DNA, 25 bp, mus musculus
ctgctctcctgcttcaagaaggacc

SEQ ID NO: 116037 - DNA, 25 bp, mus musculus
ctgcacaaagcggagacctacctgc

SEQ ID NO: 116038 - DNA, 25 bp, mus musculus
gagacctacctgcgggtcatgaagt

SEQ ID NO: 116039 - DNA, 25 bp, mus musculus
accagtgtctctgctgcactctcct

SEQ ID NO: 116040 - DNA, 25 bp, mus musculus
tattccattcagaatgcccaggctg

SEQ ID NO: 116041 - DNA, 25 bp, mus musculus
attcagaatgcccaggctgctttct

SEQ ID NO: 116042 - DNA, 25 bp, mus musculus
caggctgctttctgcttctcagaga

SEQ ID NO: 116043 - DNA, 25 bp, mus musculus
ttgcttcgcttctcgctgctgctca

SEQ ID NO: 116044 - DNA, 25 bp, mus musculus
cagttcctcagcaggattttcacca

SEQ ID NO: 116045 - DNA, 25 bp, mus musculus
aggattttcaccaacagcctgatgt

SEQ ID NO: 116046 - DNA, 25 bp, mus musculus
aacagcctgatgttcggcacctcgg

SEQ ID NO: 116047 - DNA, 25 bp, mus musculus
ctgatgttcggcacctcggaccgtg

SEQ ID NO: 116048 - DNA, 25 bp, mus musculus
tgccctacttctacgtcctctactt

SEQ ID NO: 116049 - DNA, 25 bp, mus musculus
tctacgtcctctacttcactgcact

SEQ ID NO: 116050 - DNA, 25 bp, mus musculus
cgtgtgccttaccgaatcataccct

SEQ ID NO: 116051 - DNA, 25 bp, mus musculus
gtgccttaccgaatcataccctatg

SEQ ID NO: 116052 - DNA, 25 bp, mus musculus
taccgaatcataccctatgtctact

SEQ ID NO: 116053 - DNA, 25 bp, mus musculus
cgaatcataccctatgtctactgaa

SEQ ID NO: 116054 - DNA, 25 bp, mus musculus
atcataccctatgtctactgaagca

SEQ ID NO: 116055 - DNA, 25 bp, mus musculus
ccctatgtctactgaagcaggtcca

SEQ ID NO: 116056 - DNA, 25 bp, mus musculus
tatgtctactgaagcaggtccacct

SEQ ID NO: 116057 - DNA, 25 bp, mus musculus
tgaagcaggtccacctaagaggttg

SEQ ID NO: 116058 - DNA, 25 bp, mus musculus
aagccactgcttccagaaggaaagt

SEQ ID NO: 116059 - DNA, 25 bp, mus musculus
ccactgcttccagaaggaaagtatt

SEQ ID NO: 116060 - DNA, 25 bp, mus musculus
acgtcctctacttcactgcactgct

SEQ ID NO: 116061 - DNA, 25 bp, mus musculus
tcctctacttcactgcactgctggt

SEQ ID NO: 116062 - DNA, 25 bp, mus musculus
acttcactgcactgctggtgaccgc

SEQ ID NO: 116063 - DNA, 25 bp, mus musculus
tcactgcactgctggtgaccgcgag

SEQ ID NO: 116064 - DNA, 25 bp, mus musculus
gcagcagtgcctccaaaagtatggc

SEQ ID NO: 116065 - DNA, 25 bp, mus musculus
aaagtatggccgtgctggcaggagt

SEQ ID NO: 116066 - DNA, 25 bp, mus musculus
tactgcaagcgtgtgccttaccgaa

SEQ ID NO: 116067 - DNA, 25 bp, mus musculus
aagcgtgtgccttaccgaatcatac

SEQ ID NO: 116068 - DNA, 25 bp, mus musculus
gtgcctacttttgtgagtcagatgc

SEQ ID NO: 116069 - DNA, 25 bp, mus musculus
acatttacatcaccacagaaagcct

SEQ ID NO: 116070 - DNA, 25 bp, mus musculus
ttcacaccgtgcagtctccaagggg

SEQ ID NO: 116071 - DNA, 25 bp, mus musculus
gccttatactcaacgcaactgcttt

SEQ ID NO: 116072 - DNA, 25 bp, mus musculus
tactcaacgcaactgctttgccttt

SEQ ID NO: 116073 - DNA, 25 bp, mus musculus
acgcaactgctttgcctttgcctga

SEQ ID NO: 116074 - DNA, 25 bp, mus musculus
ctgctttgcctttgcctgacaaaaa

SEQ ID NO: 116075 - DNA, 25 bp, mus musculus
atgtgagcacagaccaactgaacaa

SEQ ID NO: 116076 - DNA, 25 bp, mus musculus
gcacagaccaactgaacaaaatcat

SEQ ID NO: 116077 - DNA, 25 bp, mus musculus
accaactgaacaaaatcatgcagta

SEQ ID NO: 116078 - DNA, 25 bp, mus musculus
tgcagtagtagcctttcctatcttt

SEQ ID NO: 116079 - DNA, 25 bp, mus musculus
ttttaaatctgtgttgggagagcat

SEQ ID NO: 116080 - DNA, 25 bp, mus musculus
acatcaccacagaaagccttaccac

SEQ ID NO: 116081 - DNA, 25 bp, mus musculus
ccacagaaagccttaccactactgc

SEQ ID NO: 116082 - DNA, 25 bp, mus musculus
aaagccttaccactactgcccagat

SEQ ID NO: 116083 - DNA, 25 bp, mus musculus
ctactgcccagatgtctgagacagc

SEQ ID NO: 116084 - DNA, 25 bp, mus musculus
cagatattgctccagatgctgagat

SEQ ID NO: 116085 - DNA, 25 bp, mus musculus
ttgctccagatgctgagatgtctgt

SEQ ID NO: 116086 - DNA, 25 bp, mus musculus
tgtctgtcccagactacaccacggt

SEQ ID NO: 116087 - DNA, 25 bp, mus musculus
actacaccacggttcacaccgtgca

SEQ ID NO: 116088 - DNA, 25 bp, mus musculus
gagatgaaccgcatgcatgagagca

SEQ ID NO: 116089 - DNA, 25 bp, mus musculus
gatgaaccgcatgcatgagagcatg

SEQ ID NO: 116090 - DNA, 25 bp, mus musculus
agagatacgccattctggagacaaa

SEQ ID NO: 116091 - DNA, 25 bp, mus musculus
agatacgccattctggagacaaagc

SEQ ID NO: 116092 - DNA, 25 bp, mus musculus
atacgccattctggagacaaagcca

SEQ ID NO: 116093 - DNA, 25 bp, mus musculus
acgccattctggagacaaagccacc

SEQ ID NO: 116094 - DNA, 25 bp, mus musculus
aaagccacctgctattctcgtagct

SEQ ID NO: 116095 - DNA, 25 bp, mus musculus
agccacctgctattctcgtagcttt

SEQ ID NO: 116096 - DNA, 25 bp, mus musculus
ccacctgctattctcgtagctttaa

SEQ ID NO: 116097 - DNA, 25 bp, mus musculus
acctgctattctcgtagctttaaag

SEQ ID NO: 116098 - DNA, 25 bp, mus musculus
ctgctattctcgtagctttaaagaa

SEQ ID NO: 116099 - DNA, 25 bp, mus musculus
tgctattctcgtagctttaaagaaa

SEQ ID NO: 116100 - DNA, 25 bp, mus musculus
aagatcacacagagctccctgacca

SEQ ID NO: 116101 - DNA, 25 bp, mus musculus
gatcacacagagctccctgaccatc

SEQ ID NO: 116102 - DNA, 25 bp, mus musculus
agctacatccagagcaagtttgagg

SEQ ID NO: 116103 - DNA, 25 bp, mus musculus
ctacatccagagcaagtttgaggat

SEQ ID NO: 116104 - DNA, 25 bp, mus musculus
taagcgcaaagacaccaaggagatc

SEQ ID NO: 116105 - DNA, 25 bp, mus musculus
agcgcaaagacaccaaggagatcta

SEQ ID NO: 116106 - DNA, 25 bp, mus musculus
agatctacacgcacttcacatgcgc

SEQ ID NO: 116107 - DNA, 25 bp, mus musculus
tgagagatacgccattctggagaca

SEQ ID NO: 116108 - DNA, 25 bp, mus musculus
cttctagacctcacaccatggttca

SEQ ID NO: 116109 - DNA, 25 bp, mus musculus
gacctcacaccatggttcacttcac

SEQ ID NO: 116110 - DNA, 25 bp, mus musculus
agctcctgggcaacatgttggtgat

SEQ ID NO: 116111 - DNA, 25 bp, mus musculus
tttctactcattttgccaaggaatt

SEQ ID NO: 116112 - DNA, 25 bp, mus musculus
ttgccaaggaattcaccccagaggt

SEQ ID NO: 116113 - DNA, 25 bp, mus musculus
tcaccccagaggtgcaggctgcctg

SEQ ID NO: 116114 - DNA, 25 bp, mus musculus
attaaactccattccagtacactgg

SEQ ID NO: 116115 - DNA, 25 bp, mus musculus
ctccattccagtacactggcaatcc

SEQ ID NO: 116116 - DNA, 25 bp, mus musculus
acactggcaatcccatgtgtctatg

SEQ ID NO: 116117 - DNA, 25 bp, mus musculus
ccatgtgtctatgatgccctctttg

SEQ ID NO: 116118 - DNA, 25 bp, mus musculus
ctctttgactccatggggactgaat

SEQ ID NO: 116119 - DNA, 25 bp, mus musculus
gactccatggggactgaattaggca

SEQ ID NO: 116120 - DNA, 25 bp, mus musculus
acaccatggttcacttcacagctga

SEQ ID NO: 116121 - DNA, 25 bp, mus musculus
acttcacagctgaggagaaggcagc

SEQ ID NO: 116122 - DNA, 25 bp, mus musculus
aggcagctatcacaagcatctggga

SEQ ID NO: 116123 - DNA, 25 bp, mus musculus
aaactctgggaaggctcctgattgt

SEQ ID NO: 116124 - DNA, 25 bp, mus musculus
tgattgtttacccatggactcagag

SEQ ID NO: 116125 - DNA, 25 bp, mus musculus
aagtgctgacatccttgggcttggg

SEQ ID NO: 116126 - DNA, 25 bp, mus musculus
agaacatggacaacctcaaggagac

SEQ ID NO: 116127 - DNA, 25 bp, mus musculus
aggagacctttgctcatctcagtga

SEQ ID NO: 116128 - DNA, 25 bp, mus musculus
tccctggagggcaagcctttgtgag

SEQ ID NO: 116129 - DNA, 25 bp, mus musculus
ggagcatcttaacagccccagacct

SEQ ID NO: 116130 - DNA, 25 bp, mus musculus
tcctcttgggttgacgcagaccaag

SEQ ID NO: 116131 - DNA, 25 bp, mus musculus
gacgcagaccaagtcccgtcctagg

SEQ ID NO: 116132 - DNA, 25 bp, mus musculus
gcagaccaagtcccgtcctaggcac

SEQ ID NO: 116133 - DNA, 25 bp, mus musculus
gctgccaacttctaaccacaatagt

SEQ ID NO: 116134 - DNA, 25 bp, mus musculus
gccaacttctaaccacaatagtgac

SEQ ID NO: 116135 - DNA, 25 bp, mus musculus
aacttctaaccacaatagtgactct

SEQ ID NO: 116136 - DNA, 25 bp, mus musculus
taaccacaatagtgactctgtgctt

SEQ ID NO: 116137 - DNA, 25 bp, mus musculus
caatagtgactctgtgcttgtctgt

SEQ ID NO: 116138 - DNA, 25 bp, mus musculus
tttgatcttgaccactcatggaagc

SEQ ID NO: 116139 - DNA, 25 bp, mus musculus
gatcttgaccactcatggaagcagg

SEQ ID NO: 116140 - DNA, 25 bp, mus musculus
gcatcttaacagccccagacctgct

SEQ ID NO: 116141 - DNA, 25 bp, mus musculus
cagacctgctcttgggtgttgcagg

SEQ ID NO: 116142 - DNA, 25 bp, mus musculus
ctggccttcccaaactgcttttgat

SEQ ID NO: 116143 - DNA, 25 bp, mus musculus
gccttcccaaactgcttttgatctt

SEQ ID NO: 116144 - DNA, 25 bp, mus musculus
ccaaactgcttttgatcttctgatt

SEQ ID NO: 116145 - DNA, 25 bp, mus musculus
aactgcttttgatcttctgattcct

SEQ ID NO: 116146 - DNA, 25 bp, mus musculus
tgatcttctgattcctcttgggttg

SEQ ID NO: 116147 - DNA, 25 bp, mus musculus
tctgattcctcttgggttgacgcag

SEQ ID NO: 116148 - DNA, 25 bp, mus musculus
ctaggcatcatctacagagacctga

SEQ ID NO: 116149 - DNA, 25 bp, mus musculus
ttaattctggatgccgatggctacc

SEQ ID NO: 116150 - DNA, 25 bp, mus musculus
atgatgacctacaatttgattctca

SEQ ID NO: 116151 - DNA, 25 bp, mus musculus
aagataacaaggcgccctgaggatt

SEQ ID NO: 116152 - DNA, 25 bp, mus musculus
ttgatccggaggctttgcaggcaaa

SEQ ID NO: 116153 - DNA, 25 bp, mus musculus
tcacctttacggagagagctcagtg

SEQ ID NO: 116154 - DNA, 25 bp, mus musculus
agagagctcagtggccccatagatc

SEQ ID NO: 116155 - DNA, 25 bp, mus musculus
ctcagtggccccatagatcacagct

SEQ ID NO: 116156 - DNA, 25 bp, mus musculus
ggccccatagatcacagctactttg

SEQ ID NO: 116157 - DNA, 25 bp, mus musculus
atagatcacagctactttgacaagt

SEQ ID NO: 116158 - DNA, 25 bp, mus musculus
cacagctactttgacaagtatcctc

SEQ ID NO: 116159 - DNA, 25 bp, mus musculus
tactttgacaagtatcctcctgaaa

SEQ ID NO: 116160 - DNA, 25 bp, mus musculus
aagattggctctggacagaaaacgt

SEQ ID NO: 116161 - DNA, 25 bp, mus musculus
tggacattctgtgggactccagagt

SEQ ID NO: 116162 - DNA, 25 bp, mus musculus
ttctgtgggactccagagtatgtgg

SEQ ID NO: 116163 - DNA, 25 bp, mus musculus
ggacatgacttcagtgtggatttct

SEQ ID NO: 116164 - DNA, 25 bp, mus musculus
gacttcagtgtggatttctggtccc

SEQ ID NO: 116165 - DNA, 25 bp, mus musculus
gatttctggtccctggggattctgg

SEQ ID NO: 116166 - DNA, 25 bp, mus musculus
attctggtctatgagctcctaacgg

SEQ ID NO: 116167 - DNA, 25 bp, mus musculus
gtctatgagctcctaacgggcaacc

SEQ ID NO: 116168 - DNA, 25 bp, mus musculus
taaagttacaactacctcactgcag

SEQ ID NO: 116169 - DNA, 25 bp, mus musculus
tacaactacctcactgcagactcaa

SEQ ID NO: 116170 - DNA, 25 bp, mus musculus
gtcctgctgagaggtgtccaagata

SEQ ID NO: 116171 - DNA, 25 bp, mus musculus
ccttggctttgtgaactcttgaaag

SEQ ID NO: 116172 - DNA, 25 bp, mus musculus
gaactcttgaaagcctgctgtgtga

SEQ ID NO: 116173 - DNA, 25 bp, mus musculus
tgtgtgaacattctcactaaattaa

SEQ ID NO: 116174 - DNA, 25 bp, mus musculus
aacattctcactaaattaagagcta

SEQ ID NO: 116175 - DNA, 25 bp, mus musculus
tatgagctggtcctccatttcccag

SEQ ID NO: 116176 - DNA, 25 bp, mus musculus
ctccatttcccaggtgatccaaatg

SEQ ID NO: 116177 - DNA, 25 bp, mus musculus
cctgcgggtaccacatgtatgtggt

SEQ ID NO: 116178 - DNA, 25 bp, mus musculus
ggtaccacatgtatgtggtatgtgg

SEQ ID NO: 116179 - DNA, 25 bp, mus musculus
tatgtggatctacatgtggggaaaa

SEQ ID NO: 116180 - DNA, 25 bp, mus musculus
tacctcactgcagactcaaaggtgt

SEQ ID NO: 116181 - DNA, 25 bp, mus musculus
gactcaaaggtgtccccagacactt

SEQ ID NO: 116182 - DNA, 25 bp, mus musculus
tccccagacacttcctgacactagt

SEQ ID NO: 116183 - DNA, 25 bp, mus musculus
gacacttcctgacactagtgtttct

SEQ ID NO: 116184 - DNA, 25 bp, mus musculus
tcctgacactagtgtttctatttgg

SEQ ID NO: 116185 - DNA, 25 bp, mus musculus
gacatcaaagcttttcttccgtggg

SEQ ID NO: 116186 - DNA, 25 bp, mus musculus
taacttacagtgccttaggctcagt

SEQ ID NO: 116187 - DNA, 25 bp, mus musculus
taatatgtcctgctgagaggtgtcc

SEQ ID NO: 116188 - DNA, 25 bp, mus musculus
agggactcactgtcagagttagcgt

SEQ ID NO: 116189 - DNA, 25 bp, mus musculus
actcactgtcagagttagcgtggat

SEQ ID NO: 116190 - DNA, 25 bp, mus musculus
gggtaccctgtcttcttgcctgtgg

SEQ ID NO: 116191 - DNA, 25 bp, mus musculus
agttagttctctccgcattctttag

SEQ ID NO: 116192 - DNA, 25 bp, mus musculus
ttagttctctccgcattctttagga

SEQ ID NO: 116193 - DNA, 25 bp, mus musculus
ttctctccgcattctttaggaggat

SEQ ID NO: 116194 - DNA, 25 bp, mus musculus
ctctccgcattctttaggaggattc

SEQ ID NO: 116195 - DNA, 25 bp, mus musculus
cttgctcctggtggcagcagctgag

SEQ ID NO: 116196 - DNA, 25 bp, mus musculus
aggacatctgtggccctgagccggc

SEQ ID NO: 116197 - DNA, 25 bp, mus musculus
acatcttcccaggccaagatgcagg

SEQ ID NO: 116198 - DNA, 25 bp, mus musculus
atcttcccaggccaagatgcagggg

SEQ ID NO: 116199 - DNA, 25 bp, mus musculus
gtccttgtttgttgcctgatcttag

SEQ ID NO: 116200 - DNA, 25 bp, mus musculus
tcactgtcagagttagcgtggattg

SEQ ID NO: 116201 - DNA, 25 bp, mus musculus
tggattgctgctgccggggcactac

SEQ ID NO: 116202 - DNA, 25 bp, mus musculus
ttgctgctgccggggcactacctcc

SEQ ID NO: 116203 - DNA, 25 bp, mus musculus
tctctccctgctgacgtggctcttg

SEQ ID NO: 116204 - DNA, 25 bp, mus musculus
gctcttgtcctggagcagagcagtg

SEQ ID NO: 116205 - DNA, 25 bp, mus musculus
tcttgtcctggagcagagcagtgcg

SEQ ID NO: 116206 - DNA, 25 bp, mus musculus
gtctatgcgtgggtaccctgtcttc

SEQ ID NO: 116207 - DNA, 25 bp, mus musculus
atgcgtgggtaccctgtcttcttgc

SEQ ID NO: 116208 - DNA, 25 bp, mus musculus
cagcccttcgcggctctgcacaggg

SEQ ID NO: 116209 - DNA, 25 bp, mus musculus
agcccttcgcggctctgcacagggc

SEQ ID NO: 116210 - DNA, 25 bp, mus musculus
tgcacagggcagttctactgcgagc

SEQ ID NO: 116211 - DNA, 25 bp, mus musculus
ggcagttctactgcgagctgctccc

SEQ ID NO: 116212 - DNA, 25 bp, mus musculus
gcagttctactgcgagctgctcccg

SEQ ID NO: 116213 - DNA, 25 bp, mus musculus
cagttctactgcgagctgctcccgc

SEQ ID NO: 116214 - DNA, 25 bp, mus musculus
aagcaggcactgccaccgggcgaat

SEQ ID NO: 116215 - DNA, 25 bp, mus musculus
caggcactgccaccgggcgaatcgt

SEQ ID NO: 116216 - DNA, 25 bp, mus musculus
aggcactgccaccgggcgaatcgtg

SEQ ID NO: 116217 - DNA, 25 bp, mus musculus
ggcactgccaccgggcgaatcgtgg

SEQ ID NO: 116218 - DNA, 25 bp, mus musculus
gcactgccaccgggcgaatcgtggc

SEQ ID NO: 116219 - DNA, 25 bp, mus musculus
cactgccaccgggcgaatcgtggca

SEQ ID NO: 116220 - DNA, 25 bp, mus musculus
gcccttcgcggctctgcacagggca

SEQ ID NO: 116221 - DNA, 25 bp, mus musculus
cttcgcggctctgcacagggcagtt

SEQ ID NO: 116222 - DNA, 25 bp, mus musculus
cgcggctctgcacagggcagttcta

SEQ ID NO: 116223 - DNA, 25 bp, mus musculus
cggctctgcacagggcagttctact

SEQ ID NO: 116224 - DNA, 25 bp, mus musculus
ggctctgcacagggcagttctactg

SEQ ID NO: 116225 - DNA, 25 bp, mus musculus
gctctgcacagggcagttctactgc

SEQ ID NO: 116226 - DNA, 25 bp, mus musculus
ctctgcacagggcagttctactgcg

SEQ ID NO: 116227 - DNA, 25 bp, mus musculus
ctgcacagggcagttctactgcgag

SEQ ID NO: 116228 - DNA, 25 bp, mus musculus
ctctctgcacatgaatactgctgtt

SEQ ID NO: 116229 - DNA, 25 bp, mus musculus
atgaatactgctgttcctgaagcac

SEQ ID NO: 116230 - DNA, 25 bp, mus musculus
aatcgtttgcttgtctgctttctac

SEQ ID NO: 116231 - DNA, 25 bp, mus musculus
gtctgctttctactttatgctaaag

SEQ ID NO: 116232 - DNA, 25 bp, mus musculus
gctttctactttatgctaaagacac

SEQ ID NO: 116233 - DNA, 25 bp, mus musculus
tttctactttatgctaaagacacat

SEQ ID NO: 116234 - DNA, 25 bp, mus musculus
tctactttatgctaaagacacatat

SEQ ID NO: 116235 - DNA, 25 bp, mus musculus
aatgactcaggcatttatctgaaac

SEQ ID NO: 116236 - DNA, 25 bp, mus musculus
tgactcaggcatttatctgaaacct

SEQ ID NO: 116237 - DNA, 25 bp, mus musculus
gcatttatctgaaacctgcagggac

SEQ ID NO: 116238 - DNA, 25 bp, mus musculus
gaaacctgcagggactcaagagaga

SEQ ID NO: 116239 - DNA, 25 bp, mus musculus
aacctgcagggactcaagagagaaa

SEQ ID NO: 116240 - DNA, 25 bp, mus musculus
gaatactgctgttcctgaagcacat

SEQ ID NO: 116241 - DNA, 25 bp, mus musculus
atactgctgttcctgaagcacatca

SEQ ID NO: 116242 - DNA, 25 bp, mus musculus
ctgttcctgaagcacatcatgttaa

SEQ ID NO: 116243 - DNA, 25 bp, mus musculus
gttcctgaagcacatcatgttaata

SEQ ID NO: 116244 - DNA, 25 bp, mus musculus
tcctgaagcacatcatgttaataaa

SEQ ID NO: 116245 - DNA, 25 bp, mus musculus
taataaagcacctccgaatcaaaat

SEQ ID NO: 116246 - DNA, 25 bp, mus musculus
cctccgaatcaaaatcgtttgcttg

SEQ ID NO: 116247 - DNA, 25 bp, mus musculus
tcaaaatcgtttgcttgtctgcttt

SEQ ID NO: 116248 - DNA, 25 bp, mus musculus
acttcccgctgtcccaatggtcagg

SEQ ID NO: 116249 - DNA, 25 bp, mus musculus
gttgattccaacgacatctacgagg

SEQ ID NO: 116250 - DNA, 25 bp, mus musculus
cacgaggacttcttcttgtatcagc

SEQ ID NO: 116251 - DNA, 25 bp, mus musculus
gaggacttcttcttgtatcagcgtg

SEQ ID NO: 116252 - DNA, 25 bp, mus musculus
gacttcttcttgtatcagcgtggca

SEQ ID NO: 116253 - DNA, 25 bp, mus musculus
ttcttgtatcagcgtggcatctaca

SEQ ID NO: 116254 - DNA, 25 bp, mus musculus
ttgtatcagcgtggcatctacagcc

SEQ ID NO: 116255 - DNA, 25 bp, mus musculus
tatcagcgtggcatctacagccaca

SEQ ID NO: 116256 - DNA, 25 bp, mus musculus
cgtggcatctacagccacacacctg

SEQ ID NO: 116257 - DNA, 25 bp, mus musculus
ggcatctacagccacacacctgtaa

SEQ ID NO: 116258 - DNA, 25 bp, mus musculus
atctacagccacacacctgtaagcc

SEQ ID NO: 116259 - DNA, 25 bp, mus musculus
agccacacacctgtaagccagggga

SEQ ID NO: 116260 - DNA, 25 bp, mus musculus
aacgacatctacgaggtcacgcctg

SEQ ID NO: 116261 - DNA, 25 bp, mus musculus
gacatctacgaggtcacgcctgcgt

SEQ ID NO: 116262 - DNA, 25 bp, mus musculus
tacgaggtcacgcctgcgtaccgcc

SEQ ID NO: 116263 - DNA, 25 bp, mus musculus
gtcacgcctgcgtaccgcctgggct

SEQ ID NO: 116264 - DNA, 25 bp, mus musculus
taccgcctgggctctgatgagcagg

SEQ ID NO: 116265 - DNA, 25 bp, mus musculus
aacggccctgttcaagcactcatgg

SEQ ID NO: 116266 - DNA, 25 bp, mus musculus
cctgttcaagcactcatggaagtac

SEQ ID NO: 116267 - DNA, 25 bp, mus musculus
gttcaagcactcatggaagtacacg

SEQ ID NO: 116268 - DNA, 25 bp, mus musculus
agtgcactcaactccagcgcagctc

SEQ ID NO: 116269 - DNA, 25 bp, mus musculus
accaccatgtctctgatgaagaatg

SEQ ID NO: 116270 - DNA, 25 bp, mus musculus
accatgggtctcagcagttgcgggc

SEQ ID NO: 116271 - DNA, 25 bp, mus musculus
catgggtctcagcagttgcgggccc

SEQ ID NO: 116272 - DNA, 25 bp, mus musculus
cgggcccacggcttcaagatcatga

SEQ ID NO: 116273 - DNA, 25 bp, mus musculus
cccacggcttcaagatcatgaccgc

SEQ ID NO: 116274 - DNA, 25 bp, mus musculus
gcttcaagatcatgaccgccgtagg

SEQ ID NO: 116275 - DNA, 25 bp, mus musculus
caagatcatgaccgccgtagggatg

SEQ ID NO: 116276 - DNA, 25 bp, mus musculus
agatcatgaccgccgtagggatgcg

SEQ ID NO: 116277 - DNA, 25 bp, mus musculus
ttaagagcatcgacaacctctctag

SEQ ID NO: 116278 - DNA, 25 bp, mus musculus
aagagcatcgacaacctctctagtg

SEQ ID NO: 116279 - DNA, 25 bp, mus musculus
atcgacaacctctctagtgctttga

SEQ ID NO: 116280 - DNA, 25 bp, mus musculus
caccatgtctctgatgaagaatgag

SEQ ID NO: 116281 - DNA, 25 bp, mus musculus
aacctctctagtgctttgactaagc

SEQ ID NO: 116282 - DNA, 25 bp, mus musculus
aagatggctgctcaggccgagccca

SEQ ID NO: 116283 - DNA, 25 bp, mus musculus
ctcaggccgagcccattggcactga

SEQ ID NO: 116284 - DNA, 25 bp, mus musculus
caggccgagcccattggcactgaga

SEQ ID NO: 116285 - DNA, 25 bp, mus musculus
ggccgagcccattggcactgagact

SEQ ID NO: 116286 - DNA, 25 bp, mus musculus
cgacctgcaccatgggtctcagcag

SEQ ID NO: 116287 - DNA, 25 bp, mus musculus
acctgcaccatgggtctcagcagtt

SEQ ID NO: 116288 - DNA, 25 bp, mus musculus
ctgcaccatgggtctcagcagttgc

SEQ ID NO: 116289 - DNA, 25 bp, mus musculus
actcacaatcgagggagtgttggac

SEQ ID NO: 116290 - DNA, 25 bp, mus musculus
gagtgttggaccatccctggctcaa

SEQ ID NO: 116291 - DNA, 25 bp, mus musculus
gacagggccctggataatgtgctac

SEQ ID NO: 116292 - DNA, 25 bp, mus musculus
gataatgtgctaccctctgcccagc

SEQ ID NO: 116293 - DNA, 25 bp, mus musculus
taatgtgctaccctctgcccagctg

SEQ ID NO: 116294 - DNA, 25 bp, mus musculus
ccctctgcccagctgatgatggata

SEQ ID NO: 116295 - DNA, 25 bp, mus musculus
ctgcccagctgatgatggataaggc

SEQ ID NO: 116296 - DNA, 25 bp, mus musculus
atgaggatccaggacctcaaggtca

SEQ ID NO: 116297 - DNA, 25 bp, mus musculus
gaggatccaggacctcaaggtcagc

SEQ ID NO: 116298 - DNA, 25 bp, mus musculus
ggatccaggacctcaaggtcagcct

SEQ ID NO: 116299 - DNA, 25 bp, mus musculus
atccaggacctcaaggtcagcctca

SEQ ID NO: 116300 - DNA, 25 bp, mus musculus
tcaaggtcagcctcaaacccctgca

SEQ ID NO: 116301 - DNA, 25 bp, mus musculus
gtgttggaccatccctggctcaact

SEQ ID NO: 116302 - DNA, 25 bp, mus musculus
tggaccatccctggctcaactcgac

SEQ ID NO: 116303 - DNA, 25 bp, mus musculus
ccatccctggctcaactcgacaggg

SEQ ID NO: 116304 - DNA, 25 bp, mus musculus
atccctggctcaactcgacagggcc

SEQ ID NO: 116305 - DNA, 25 bp, mus musculus
ctggctcaactcgacagggccctgg

SEQ ID NO: 116306 - DNA, 25 bp, mus musculus
ggctcaactcgacagggccctggat

SEQ ID NO: 116307 - DNA, 25 bp, mus musculus
ctcaactcgacagggccctggataa

SEQ ID NO: 116308 - DNA, 25 bp, mus musculus
tcgacagggccctggataatgtgct

SEQ ID NO: 116309 - DNA, 25 bp, mus musculus
cagccttcaggtcgctttggctcag

SEQ ID NO: 116310 - DNA, 25 bp, mus musculus
ggtcgctttggctcagctttggccg

SEQ ID NO: 116311 - DNA, 25 bp, mus musculus
tactatggttcccagcaagggaggc

SEQ ID NO: 116312 - DNA, 25 bp, mus musculus
ggttcccagcaagggaggctgtctt

SEQ ID NO: 116313 - DNA, 25 bp, mus musculus
cctaaacgtcagcatctccttgcaa

SEQ ID NO: 116314 - DNA, 25 bp, mus musculus
aaacgtcagcatctccttgcaagga

SEQ ID NO: 116315 - DNA, 25 bp, mus musculus
cgtcagcatctccttgcaaggacac

SEQ ID NO: 116316 - DNA, 25 bp, mus musculus
ctccttgcaaggacacctactgtaa

SEQ ID NO: 116317 - DNA, 25 bp, mus musculus
cttgcaaggacacctactgtaactt

SEQ ID NO: 116318 - DNA, 25 bp, mus musculus
aggacacctactgtaacttgggctg

SEQ ID NO: 116319 - DNA, 25 bp, mus musculus
ggaccctcttggcaacagatgcaga

SEQ ID NO: 116320 - DNA, 25 bp, mus musculus
ccctcttggcaacagatgcagacgg

SEQ ID NO: 116321 - DNA, 25 bp, mus musculus
tcagctttggccgtgctggacttca

SEQ ID NO: 116322 - DNA, 25 bp, mus musculus
gctttggccgtgctggacttcaacc

SEQ ID NO: 116323 - DNA, 25 bp, mus musculus
ttggccgtgctggacttcaaccagg

SEQ ID NO: 116324 - DNA, 25 bp, mus musculus
ctggacttcaaccaggatgggctgc

SEQ ID NO: 116325 - DNA, 25 bp, mus musculus
gacttcaaccaggatgggctgcctg

SEQ ID NO: 116326 - DNA, 25 bp, mus musculus
aaccaggatgggctgcctgacctgg

SEQ ID NO: 116327 - DNA, 25 bp, mus musculus
gggcagctcacctacaatggctcgg

SEQ ID NO: 116328 - DNA, 25 bp, mus musculus
cagctcacctacaatggctcggtgt

SEQ ID NO: 116329 - DNA, 25 bp, mus musculus
gtccttgatcaacaccgaatatttg

SEQ ID NO: 116330 - DNA, 25 bp, mus musculus
gacttcatgggtcgctttgagggcc

SEQ ID NO: 116331 - DNA, 25 bp, mus musculus
gtgcagctttcttcttccttttcca

SEQ ID NO: 116332 - DNA, 25 bp, mus musculus
ccaagcctctgggtccttgggctct

SEQ ID NO: 116333 - DNA, 25 bp, mus musculus
ctctgggtccttgggctctccattt

SEQ ID NO: 116334 - DNA, 25 bp, mus musculus
gtccttgggctctccatttcttcat

SEQ ID NO: 116335 - DNA, 25 bp, mus musculus
gggctctccatttcttcattagtct

SEQ ID NO: 116336 - DNA, 25 bp, mus musculus
tccatttcttcattagtctcctcct

SEQ ID NO: 116337 - DNA, 25 bp, mus musculus
tcttcattagtctcctcctattccc

SEQ ID NO: 116338 - DNA, 25 bp, mus musculus
tgctgccttggtcctcagagtaagc

SEQ ID NO: 116339 - DNA, 25 bp, mus musculus
cttggtcctcagagtaagcagctaa

SEQ ID NO: 116340 - DNA, 25 bp, mus musculus
cagctaagccccatttggttctcaa

SEQ ID NO: 116341 - DNA, 25 bp, mus musculus
cgctttgagggcctgaagaagatat

SEQ ID NO: 116342 - DNA, 25 bp, mus musculus
ttcctctccaagccaatctttgcaa

SEQ ID NO: 116343 - DNA, 25 bp, mus musculus
tccaagccaatctttgcaaagatgg

SEQ ID NO: 116344 - DNA, 25 bp, mus musculus
actcatgagtgctctgctggcccta

SEQ ID NO: 116345 - DNA, 25 bp, mus musculus
gagtgctctgctggccctagctctt

SEQ ID NO: 116346 - DNA, 25 bp, mus musculus
tctgctggccctagctcttaccacg

SEQ ID NO: 116347 - DNA, 25 bp, mus musculus
agctcttaccacgtgcagctttctt

SEQ ID NO: 116348 - DNA, 25 bp, mus musculus
taccacgtgcagctttcttcttcct

SEQ ID NO: 116349 - DNA, 25 bp, mus musculus
ttgccaagctaatctgtagggctgg

SEQ ID NO: 116350 - DNA, 25 bp, mus musculus
gggctggacctatggccaaggacac

SEQ ID NO: 116351 - DNA, 25 bp, mus musculus
caggttctagtctcctgtgcactga

SEQ ID NO: 116352 - DNA, 25 bp, mus musculus
ctagtctcctgtgcactgagggcca

SEQ ID NO: 116353 - DNA, 25 bp, mus musculus
agggccacacaaacaccatgagaag

SEQ ID NO: 116354 - DNA, 25 bp, mus musculus
acacaaacaccatgagaaggacctc

SEQ ID NO: 116355 - DNA, 25 bp, mus musculus
acttaactgctgaagacacggacac

SEQ ID NO: 116356 - DNA, 25 bp, mus musculus
aagacacggacactcctgccctgct

SEQ ID NO: 116357 - DNA, 25 bp, mus musculus
ctcctgccctgctgtgtatagatgg

SEQ ID NO: 116358 - DNA, 25 bp, mus musculus
tatctggacaaacccacttgtaaat

SEQ ID NO: 116359 - DNA, 25 bp, mus musculus
ctcctgtaactttacctaagcagat

SEQ ID NO: 116360 - DNA, 25 bp, mus musculus
taactttacctaagcagatataaat

SEQ ID NO: 116361 - DNA, 25 bp, mus musculus
gacctatggccaaggacacactaat

SEQ ID NO: 116362 - DNA, 25 bp, mus musculus
cactaataccgaactctgagctagg

SEQ ID NO: 116363 - DNA, 25 bp, mus musculus
taccgaactctgagctaggaggctt

SEQ ID NO: 116364 - DNA, 25 bp, mus musculus
actctgagctaggaggctttacgct

SEQ ID NO: 116365 - DNA, 25 bp, mus musculus
ggcaccataggggtccggactccat

SEQ ID NO: 116366 - DNA, 25 bp, mus musculus
ttttaggattcgcccattcctgtct

SEQ ID NO: 116367 - DNA, 25 bp, mus musculus
atctttccttgcctgagaccagttg

SEQ ID NO: 116368 - DNA, 25 bp, mus musculus
ggctgccaggttctagtctcctgtg

SEQ ID NO: 116369 - DNA, 25 bp, mus musculus
cgtgttcttccttgccaggcaggca

SEQ ID NO: 116370 - DNA, 25 bp, mus musculus
tgccaggcaggcagcacacagctct

SEQ ID NO: 116371 - DNA, 25 bp, mus musculus
tatggaccagtgtgtcatgttgaaa

SEQ ID NO: 116372 - DNA, 25 bp, mus musculus
taattaaggccctttccttgcagtg

SEQ ID NO: 116373 - DNA, 25 bp, mus musculus
ccctttccttgcagtggaaatcaga

SEQ ID NO: 116374 - DNA, 25 bp, mus musculus
tttccttgcagtggaaatcagacag

SEQ ID NO: 116375 - DNA, 25 bp, mus musculus
acagtaactactgtaactgcaagtg

SEQ ID NO: 116376 - DNA, 25 bp, mus musculus
actactgtaactgcaagtgagaggc

SEQ ID NO: 116377 - DNA, 25 bp, mus musculus
caacaaactggaacccatccagtgg

SEQ ID NO: 116378 - DNA, 25 bp, mus musculus
caaactggaacccatccagtggaag

SEQ ID NO: 116379 - DNA, 25 bp, mus musculus
aactcagaggctttgtggctatact

SEQ ID NO: 116380 - DNA, 25 bp, mus musculus
gctttgtggctatactgctgccgtt

SEQ ID NO: 116381 - DNA, 25 bp, mus musculus
ggatgctttgccaacactcagaaat

SEQ ID NO: 116382 - DNA, 25 bp, mus musculus
tgctttgccaacactcagaaatgcc

SEQ ID NO: 116383 - DNA, 25 bp, mus musculus
tttgccaacactcagaaatgccaca

SEQ ID NO: 116384 - DNA, 25 bp, mus musculus
ggacactcacagccctcattcagtg

SEQ ID NO: 116385 - DNA, 25 bp, mus musculus
tcacagccctcattcagtgtgtaag

SEQ ID NO: 116386 - DNA, 25 bp, mus musculus
ggcacattgactccttcagagtatg

SEQ ID NO: 116387 - DNA, 25 bp, mus musculus
ttgactccttcagagtatggaccag

SEQ ID NO: 116388 - DNA, 25 bp, mus musculus
actccttcagagtatggaccagtgt

SEQ ID NO: 116389 - DNA, 25 bp, mus musculus
ttgctgttgctgaaaacgggagagt

SEQ ID NO: 116390 - DNA, 25 bp, mus musculus
gccctggagcatcttcctcaccagg

SEQ ID NO: 116391 - DNA, 25 bp, mus musculus
tgtttacacctctgctgctgagact

SEQ ID NO: 116392 - DNA, 25 bp, mus musculus
cacctctgctgctgagactttcaca

SEQ ID NO: 116393 - DNA, 25 bp, mus musculus
tgctgctgagactttcacagaaacc

SEQ ID NO: 116394 - DNA, 25 bp, mus musculus
tttcacagaaacctccagatggtac

SEQ ID NO: 116395 - DNA, 25 bp, mus musculus
ctccagatggtactaggggacacag

SEQ ID NO: 116396 - DNA, 25 bp, mus musculus
cagagccaagacgtcacatctgact

SEQ ID NO: 116397 - DNA, 25 bp, mus musculus
caagacgtcacatctgactgcagac

SEQ ID NO: 116398 - DNA, 25 bp, mus musculus
gtcacatctgactgcagactttccc

SEQ ID NO: 116399 - DNA, 25 bp, mus musculus
ctccaccaaagcacccaaagatcat

SEQ ID NO: 116400 - DNA, 25 bp, mus musculus
caaagcacccaaagatcattgtttg

SEQ ID NO: 116401 - DNA, 25 bp, mus musculus
gagcatcttcctcaccaggtgacca

SEQ ID NO: 116402 - DNA, 25 bp, mus musculus
cttcctcaccaggtgaccaggctct

SEQ ID NO: 116403 - DNA, 25 bp, mus musculus
tctcttgggattgcagagtagcaat

SEQ ID NO: 116404 - DNA, 25 bp, mus musculus
tagcaatgttggtgggcaggcagac

SEQ ID NO: 116405 - DNA, 25 bp, mus musculus
tttaagatctcctgggtcttccatg

SEQ ID NO: 116406 - DNA, 25 bp, mus musculus
atctcctgggtcttccatgtttcat

SEQ ID NO: 116407 - DNA, 25 bp, mus musculus
tgggtcttccatgtttcatatcaat

SEQ ID NO: 116408 - DNA, 25 bp, mus musculus
ttccatgtttcatatcaatgaggtt

SEQ ID NO: 116409 - DNA, 25 bp, mus musculus
agaacgtgattgccctcatctacct

SEQ ID NO: 116410 - DNA, 25 bp, mus musculus
tgattgccctcatctacctggcctc

SEQ ID NO: 116411 - DNA, 25 bp, mus musculus
aggccgccaagagcttcatcttgga

SEQ ID NO: 116412 - DNA, 25 bp, mus musculus
ccaagagcttcatcttggacatgta

SEQ ID NO: 116413 - DNA, 25 bp, mus musculus
acatgtatgcgcgcgtgtacgcgag

SEQ ID NO: 116414 - DNA, 25 bp, mus musculus
gcttcttcgcacacttcacctgtgc

SEQ ID NO: 116415 - DNA, 25 bp, mus musculus
tcgcacacttcacctgtgccacgga

SEQ ID NO: 116416 - DNA, 25 bp, mus musculus
aaagcgtccgcagcgtgttcaagga

SEQ ID NO: 116417 - DNA, 25 bp, mus musculus
tcaaggacgtgcgggactcggtgct

SEQ ID NO: 116418 - DNA, 25 bp, mus musculus
tggacgagatcaacctgctgtgacg

SEQ ID NO: 116419 - DNA, 25 bp, mus musculus
agatcaacctgctgtgacgcgggac

SEQ ID NO: 116420 - DNA, 25 bp, mus musculus
gccagcccacaggagagagtccctg

SEQ ID NO: 116421 - DNA, 25 bp, mus musculus
atgaccagtgcctagaggagaacga

SEQ ID NO: 116422 - DNA, 25 bp, mus musculus
agaaccgcatggaggagagtctcgc

SEQ ID NO: 116423 - DNA, 25 bp, mus musculus
tcagcacgatcctagagctgccctg

SEQ ID NO: 116424 - DNA, 25 bp, mus musculus
tagagctgccctggttcaagagcac

SEQ ID NO: 116425 - DNA, 25 bp, mus musculus
tgccctggttcaagagcacctcggt

SEQ ID NO: 116426 - DNA, 25 bp, mus musculus
ggttcaagagcacctcggtcatcct

SEQ ID NO: 116427 - DNA, 25 bp, mus musculus
agagcacctcggtcatcctcttcct

SEQ ID NO: 116428 - DNA, 25 bp, mus musculus
agacggacatcctggaagataagat

SEQ ID NO: 116429 - DNA, 25 bp, mus musculus
tgttcttaccactctcggagaaaga

SEQ ID NO: 116430 - DNA, 25 bp, mus musculus
tcttaccactctcggagaaagatga

SEQ ID NO: 116431 - DNA, 25 bp, mus musculus
ggccttcctgaagcatatcctaagc

SEQ ID NO: 116432 - DNA, 25 bp, mus musculus
gaagcatatcctaagcctctgagct

SEQ ID NO: 116433 - DNA, 25 bp, mus musculus
gcatatcctaagcctctgagctccg

SEQ ID NO: 116434 - DNA, 25 bp, mus musculus
agcccctggtatccgcttgagaggc

SEQ ID NO: 116435 - DNA, 25 bp, mus musculus
ccctggtatccgcttgagaggcaag

SEQ ID NO: 116436 - DNA, 25 bp, mus musculus
tggtatccgcttgagaggcaagggt

SEQ ID NO: 116437 - DNA, 25 bp, mus musculus
caagggtcctcgatccaccagatag

SEQ ID NO: 116438 - DNA, 25 bp, mus musculus
gggtcctcgatccaccagatagaag

SEQ ID NO: 116439 - DNA, 25 bp, mus musculus
tcctcgatccaccagatagaagcgc

SEQ ID NO: 116440 - DNA, 25 bp, mus musculus
atccaccagatagaagcgcaggcag

SEQ ID NO: 116441 - DNA, 25 bp, mus musculus
taccactctcggagaaagatgactg

SEQ ID NO: 116442 - DNA, 25 bp, mus musculus
gagactgttctggcaggccacggac

SEQ ID NO: 116443 - DNA, 25 bp, mus musculus
cacggacagcaacggctgcatcaac

SEQ ID NO: 116444 - DNA, 25 bp, mus musculus
ggacagcaacggctgcatcaactat

SEQ ID NO: 116445 - DNA, 25 bp, mus musculus
ctgcatcaactatgaggccttcctg

SEQ ID NO: 116446 - DNA, 25 bp, mus musculus
catcaactatgaggccttcctgaag

SEQ ID NO: 116447 - DNA, 25 bp, mus musculus
ctatgaggccttcctgaagcatatc

SEQ ID NO: 116448 - DNA, 25 bp, mus musculus
tgaggccttcctgaagcatatccta

SEQ ID NO: 116449 - DNA, 25 bp, mus musculus
gtgtacctcatctatggcatgtact

SEQ ID NO: 116450 - DNA, 25 bp, mus musculus
ctcatctatggcatgtacttctgct

SEQ ID NO: 116451 - DNA, 25 bp, mus musculus
agctttgaccagcgagacctggctc

SEQ ID NO: 116452 - DNA, 25 bp, mus musculus
gaccagcgagacctggctcaagatg

SEQ ID NO: 116453 - DNA, 25 bp, mus musculus
cgagacctggctcaagatgatgctg

SEQ ID NO: 116454 - DNA, 25 bp, mus musculus
gagtccagtagcccagctgtggtgg

SEQ ID NO: 116455 - DNA, 25 bp, mus musculus
gtggcagcagcccgtataggtattg

SEQ ID NO: 116456 - DNA, 25 bp, mus musculus
aagcccttgcgcttctatgtccagg

SEQ ID NO: 116457 - DNA, 25 bp, mus musculus
ccatgggtcagtgtggtagacagag

SEQ ID NO: 116458 - DNA, 25 bp, mus musculus
atggatcagcctcagcaaacagcct

SEQ ID NO: 116459 - DNA, 25 bp, mus musculus
acagcctgctctgaggggcttttaa

SEQ ID NO: 116460 - DNA, 25 bp, mus musculus
tgctctgaggggcttttaattgttc

SEQ ID NO: 116461 - DNA, 25 bp, mus musculus
tatggcatgtacttctgcttgaatg

SEQ ID NO: 116462 - DNA, 25 bp, mus musculus
atgtacttctgcttgaatgtctcta

SEQ ID NO: 116463 - DNA, 25 bp, mus musculus
agagcactagagcccctggagggcc

SEQ ID NO: 116464 - DNA, 25 bp, mus musculus
ctggagaccatgcggcagcttcgta

SEQ ID NO: 116465 - DNA, 25 bp, mus musculus
tccctcaaggaccgtgaactctgta

SEQ ID NO: 116466 - DNA, 25 bp, mus musculus
ctctgtagtggtccctccaagctgt

SEQ ID NO: 116467 - DNA, 25 bp, mus musculus
tgccaggccctggccattgataaga

SEQ ID NO: 116468 - DNA, 25 bp, mus musculus
gccctggccattgataagagctttg

SEQ ID NO: 116469 - DNA, 25 bp, mus musculus
tctctgaaaccagaggactagctga

SEQ ID NO: 116470 - DNA, 25 bp, mus musculus
tagctgacttttgccaaggagtgtt

SEQ ID NO: 116471 - DNA, 25 bp, mus musculus
attccaccttcagggcctacagagt

SEQ ID NO: 116472 - DNA, 25 bp, mus musculus
ccttcagggcctacagagtgaggga

SEQ ID NO: 116473 - DNA, 25 bp, mus musculus
agagaagccctctcgtgaactgccc

SEQ ID NO: 116474 - DNA, 25 bp, mus musculus
gccctctcgtgaactgcccggttgg

SEQ ID NO: 116475 - DNA, 25 bp, mus musculus
tcgtgaactgcccggttggtattga

SEQ ID NO: 116476 - DNA, 25 bp, mus musculus
aatcccagtccactgaaagtgccat

SEQ ID NO: 116477 - DNA, 25 bp, mus musculus
agtccactgaaagtgccattgacca

SEQ ID NO: 116478 - DNA, 25 bp, mus musculus
gtgccattgaccaccgctgcatccg

SEQ ID NO: 116479 - DNA, 25 bp, mus musculus
ttgaccaccgctgcatccgggctgt

SEQ ID NO: 116480 - DNA, 25 bp, mus musculus
gcatccgggctgtacaagacgacac

SEQ ID NO: 116481 - DNA, 25 bp, mus musculus
tggacactatccaccacactttgct

SEQ ID NO: 116482 - DNA, 25 bp, mus musculus
ctcccggatgctccaggacacacat

SEQ ID NO: 116483 - DNA, 25 bp, mus musculus
gatgctccaggacacacatacaccc

SEQ ID NO: 116484 - DNA, 25 bp, mus musculus
ggctgccgactgcattctctccttg

SEQ ID NO: 116485 - DNA, 25 bp, mus musculus
cattctctccttgtgcccacaggca

SEQ ID NO: 116486 - DNA, 25 bp, mus musculus
acaggcactggcctgggactttcat

SEQ ID NO: 116487 - DNA, 25 bp, mus musculus
cactctagcctttctcaggctgcac

SEQ ID NO: 116488 - DNA, 25 bp, mus musculus
gctgcaccaaagattccaccttcag

SEQ ID NO: 116489 - DNA, 25 bp, mus musculus
tggtcttacatccgctactttacac

SEQ ID NO: 116490 - DNA, 25 bp, mus musculus
tacatccgctactttacacatttgc

SEQ ID NO: 116491 - DNA, 25 bp, mus musculus
atctctctggtcacaatgcaatcat

SEQ ID NO: 116492 - DNA, 25 bp, mus musculus
ctggtcacaatgcaatcattaacac

SEQ ID NO: 116493 - DNA, 25 bp, mus musculus
acaatgcaatcattaacacgctggc

SEQ ID NO: 116494 - DNA, 25 bp, mus musculus
caatcattaacacgctggcggtcaa

SEQ ID NO: 116495 - DNA, 25 bp, mus musculus
acaatggcaccatgcacctttggga

SEQ ID NO: 116496 - DNA, 25 bp, mus musculus
gcaccatgcacctttgggactggag

SEQ ID NO: 116497 - DNA, 25 bp, mus musculus
attttcagcgcgtccatgcagctgt

SEQ ID NO: 116498 - DNA, 25 bp, mus musculus
agcgcgtccatgcagctgtacagcc

SEQ ID NO: 116499 - DNA, 25 bp, mus musculus
tacagcctgggtctttggacagtga

SEQ ID NO: 116500 - DNA, 25 bp, mus musculus
ttgcttgtgctttcgatcggtcaga

SEQ ID NO: 116501 - DNA, 25 bp, mus musculus
cgctactttacacatttgcgtctgg

SEQ ID NO: 116502 - DNA, 25 bp, mus musculus
tttacacatttgcgtctggttctcc

SEQ ID NO: 116503 - DNA, 25 bp, mus musculus
catttgcgtctggttctccagataa

SEQ ID NO: 116504 - DNA, 25 bp, mus musculus
gttctccagataacataaagcagtg

SEQ ID NO: 116505 - DNA, 25 bp, mus musculus
ggaaattccccgatggaggcttcat

SEQ ID NO: 116506 - DNA, 25 bp, mus musculus
tccccgatggaggcttcattcaaaa

SEQ ID NO: 116507 - DNA, 25 bp, mus musculus
gcttcattcaaaatctctctggtca

SEQ ID NO: 116508 - DNA, 25 bp, mus musculus
ttcaaaatctctctggtcacaatgc

SEQ ID NO: 116509 - DNA, 25 bp, mus musculus
ttcagcccgtggaccacagctatgt

SEQ ID NO: 116510 - DNA, 25 bp, mus musculus
gtggaccacagctatgtagtagcca

SEQ ID NO: 116511 - DNA, 25 bp, mus musculus
cactgaggccggtctgcgagaaacc

SEQ ID NO: 116512 - DNA, 25 bp, mus musculus
ctgaggccggtctgcgagaaaccca

SEQ ID NO: 116513 - DNA, 25 bp, mus musculus
ctagaggccattgctcaggacccaa

SEQ ID NO: 116514 - DNA, 25 bp, mus musculus
aggccattgctcaggacccaaacac

SEQ ID NO: 116515 - DNA, 25 bp, mus musculus
cattgctcaggacccaaacacatgt

SEQ ID NO: 116516 - DNA, 25 bp, mus musculus
ttgctcaggacccaaacacatgtga

SEQ ID NO: 116517 - DNA, 25 bp, mus musculus
gctcaggacccaaacacatgtgaga

SEQ ID NO: 116518 - DNA, 25 bp, mus musculus
tcaggacccaaacacatgtgagatc

SEQ ID NO: 116519 - DNA, 25 bp, mus musculus
gacccaaacacatgtgagatctgtg

SEQ ID NO: 116520 - DNA, 25 bp, mus musculus
cccaaacacatgtgagatctgtgcc

SEQ ID NO: 116521 - DNA, 25 bp, mus musculus
ggaccacagctatgtagtagccact

SEQ ID NO: 116522 - DNA, 25 bp, mus musculus
gctatgtagtagccactctgcactt

SEQ ID NO: 116523 - DNA, 25 bp, mus musculus
tatgtagtagccactctgcacttcc

SEQ ID NO: 116524 - DNA, 25 bp, mus musculus
tagtagccactctgcacttccagaa

SEQ ID NO: 116525 - DNA, 25 bp, mus musculus
agccactctgcacttccagaagcac

SEQ ID NO: 116526 - DNA, 25 bp, mus musculus
ccactctgcacttccagaagcactg

SEQ ID NO: 116527 - DNA, 25 bp, mus musculus
tctgcacttccagaagcactgaggc

SEQ ID NO: 116528 - DNA, 25 bp, mus musculus
cacttccagaagcactgaggccggt

SEQ ID NO: 116529 - DNA, 25 bp, mus musculus
tggcagctcaacttccgggtcaggc

SEQ ID NO: 116530 - DNA, 25 bp, mus musculus
gcagctcaacttccgggtcaggctc

SEQ ID NO: 116531 - DNA, 25 bp, mus musculus
cgcatgcgcagagagttaggtctct

SEQ ID NO: 116532 - DNA, 25 bp, mus musculus
ggtctctttttctcgtcttccagca

SEQ ID NO: 116533 - DNA, 25 bp, mus musculus
ctctttttctcgtcttccagcattc

SEQ ID NO: 116534 - DNA, 25 bp, mus musculus
ctttttctcgtcttccagcattctc

SEQ ID NO: 116535 - DNA, 25 bp, mus musculus
tttctcgtcttccagcattctccga

SEQ ID NO: 116536 - DNA, 25 bp, mus musculus
ttctcgtcttccagcattctccgag

SEQ ID NO: 116537 - DNA, 25 bp, mus musculus
tcgtcttccagcattctccgagact

SEQ ID NO: 116538 - DNA, 25 bp, mus musculus
gtcttccagcattctccgagactta

SEQ ID NO: 116539 - DNA, 25 bp, mus musculus
tcttccagcattctccgagacttaa

SEQ ID NO: 116540 - DNA, 25 bp, mus musculus
ttccagcattctccgagacttaagg

SEQ ID NO: 116541 - DNA, 25 bp, mus musculus
cagctcaacttccgggtcaggctct

SEQ ID NO: 116542 - DNA, 25 bp, mus musculus
ttccgggtcaggctctaacgcatgc

SEQ ID NO: 116543 - DNA, 25 bp, mus musculus
gtcaggctctaacgcatgcgcagag

SEQ ID NO: 116544 - DNA, 25 bp, mus musculus
caggctctaacgcatgcgcagagag

SEQ ID NO: 116545 - DNA, 25 bp, mus musculus
aggctctaacgcatgcgcagagagt

SEQ ID NO: 116546 - DNA, 25 bp, mus musculus
gctctaacgcatgcgcagagagtta

SEQ ID NO: 116547 - DNA, 25 bp, mus musculus
ctaacgcatgcgcagagagttaggt

SEQ ID NO: 116548 - DNA, 25 bp, mus musculus
taacgcatgcgcagagagttaggtc

SEQ ID NO: 116549 - DNA, 25 bp, mus musculus
gacacatccctacatagtggaggaa

SEQ ID NO: 116550 - DNA, 25 bp, mus musculus
agactattccttagaatatttcata

SEQ ID NO: 116551 - DNA, 25 bp, mus musculus
catagaatttcccctacacagacca

SEQ ID NO: 116552 - DNA, 25 bp, mus musculus
cctacacagaccaaatcatagcaga

SEQ ID NO: 116553 - DNA, 25 bp, mus musculus
acacagaccaaatcatagcagagat

SEQ ID NO: 116554 - DNA, 25 bp, mus musculus
cagaccaaatcatagcagagatatt

SEQ ID NO: 116555 - DNA, 25 bp, mus musculus
agaacgcagtcctgaaaagtatgtc

SEQ ID NO: 116556 - DNA, 25 bp, mus musculus
cagagtatcacgtgctttgttcaac

SEQ ID NO: 116557 - DNA, 25 bp, mus musculus
ttagactacaacacccactcactcg

SEQ ID NO: 116558 - DNA, 25 bp, mus musculus
acccactcactcgggaaagtatgtg

SEQ ID NO: 116559 - DNA, 25 bp, mus musculus
tgtgaactcacattcaataattact

SEQ ID NO: 116560 - DNA, 25 bp, mus musculus
gaactcacattcaataattactaat

SEQ ID NO: 116561 - DNA, 25 bp, mus musculus
ctattccttagaatatttcatactg

SEQ ID NO: 116562 - DNA, 25 bp, mus musculus
atatttcatactgtacagtatatag

SEQ ID NO: 116563 - DNA, 25 bp, mus musculus
atgttagctgacagtcatgagtagt

SEQ ID NO: 116564 - DNA, 25 bp, mus musculus
ttagctgacagtcatgagtagtgtt

SEQ ID NO: 116565 - DNA, 25 bp, mus musculus
taatatacaatccactttaacaaca

SEQ ID NO: 116566 - DNA, 25 bp, mus musculus
tatacaatccactttaacaacatgg

SEQ ID NO: 116567 - DNA, 25 bp, mus musculus
ttgtctatcaccttaactacggaat

SEQ ID NO: 116568 - DNA, 25 bp, mus musculus
aactcaaggccaggagagcatagaa

SEQ ID NO: 116569 - DNA, 25 bp, mus musculus
gtggacaacagcatctcggtgtctg

SEQ ID NO: 116570 - DNA, 25 bp, mus musculus
aacagcatctcggtgtctgtgccca

SEQ ID NO: 116571 - DNA, 25 bp, mus musculus
tggagtgacacccagaacaacttct

SEQ ID NO: 116572 - DNA, 25 bp, mus musculus
agtgacacccagaacaacttctccg

SEQ ID NO: 116573 - DNA, 25 bp, mus musculus
cagaacaacttctccgtgacgtgcg

SEQ ID NO: 116574 - DNA, 25 bp, mus musculus
ctctgccccagctggaaatccgagg

SEQ ID NO: 116575 - DNA, 25 bp, mus musculus
aaatccgaggatcctacaatctgca

SEQ ID NO: 116576 - DNA, 25 bp, mus musculus
gatcctacaatctgcaggacctgct

SEQ ID NO: 116577 - DNA, 25 bp, mus musculus
tgcaggacctgctggctgaggacaa

SEQ ID NO: 116578 - DNA, 25 bp, mus musculus
aggacctgctggctgaggacaagct

SEQ ID NO: 116579 - DNA, 25 bp, mus musculus
caaatctgaacaacattggtgacac

SEQ ID NO: 116580 - DNA, 25 bp, mus musculus
ttctcaatagcatcctcctcgaact

SEQ ID NO: 116581 - DNA, 25 bp, mus musculus
atctcggtgtctgtgcccatgatct

SEQ ID NO: 116582 - DNA, 25 bp, mus musculus
tcctcctcgaactcaaagcaggaga

SEQ ID NO: 116583 - DNA, 25 bp, mus musculus
tcggtgtctgtgcccatgatctccg

SEQ ID NO: 116584 - DNA, 25 bp, mus musculus
gtgtctgtgcccatgatctccggca

SEQ ID NO: 116585 - DNA, 25 bp, mus musculus
atgatctccggcactggcaacttcc

SEQ ID NO: 116586 - DNA, 25 bp, mus musculus
tccggcactggcaacttccagcact

SEQ ID NO: 116587 - DNA, 25 bp, mus musculus
actggcaacttccagcactggagtg

SEQ ID NO: 116588 - DNA, 25 bp, mus musculus
aacttccagcactggagtgacaccc

SEQ ID NO: 116589 - DNA, 25 bp, mus musculus
ttccagcactggagtgacacccaga

SEQ ID NO: 116590 - DNA, 25 bp, mus musculus
tgtcccatgtctatgaagctcaaga

SEQ ID NO: 116591 - DNA, 25 bp, mus musculus
tgtgactacctctgcagtttctgtg

SEQ ID NO: 116592 - DNA, 25 bp, mus musculus
ctactgctgactgtgtgtttggaag

SEQ ID NO: 116593 - DNA, 25 bp, mus musculus
ggctgctccagccagcactggtcct

SEQ ID NO: 116594 - DNA, 25 bp, mus musculus
tccagccagcactggtcctatgggt

SEQ ID NO: 116595 - DNA, 25 bp, mus musculus
gcagaaccccagcacttcgaatgta

SEQ ID NO: 116596 - DNA, 25 bp, mus musculus
cacttcgaatgtactgtccactggc

SEQ ID NO: 116597 - DNA, 25 bp, mus musculus
atgtagatgcactggcccaggtgga

SEQ ID NO: 116598 - DNA, 25 bp, mus musculus
taacattgaccctgaggcttgtgac

SEQ ID NO: 116599 - DNA, 25 bp, mus musculus
ttgtgacctgttatggctctgtaat

SEQ ID NO: 116600 - DNA, 25 bp, mus musculus
ttttatacccagcagcgtagatttc

SEQ ID NO: 116601 - DNA, 25 bp, mus musculus
acccagcagcgtagatttcataata

SEQ ID NO: 116602 - DNA, 25 bp, mus musculus
agtggtccaggagctggcctctttg

SEQ ID NO: 116603 - DNA, 25 bp, mus musculus
ctctttgctaagcattcttcactct

SEQ ID NO: 116604 - DNA, 25 bp, mus musculus
gctaagcattcttcactctgtgtct

SEQ ID NO: 116605 - DNA, 25 bp, mus musculus
cattcttcactctgtgtcttgatgt

SEQ ID NO: 116606 - DNA, 25 bp, mus musculus
tcactctgtgtcttgatgtccctta

SEQ ID NO: 116607 - DNA, 25 bp, mus musculus
gacatgatcctcaaactgatggccg

SEQ ID NO: 116608 - DNA, 25 bp, mus musculus
aaactgatggccggcattctactgc

SEQ ID NO: 116609 - DNA, 25 bp, mus musculus
atggccggcattctactgctgactg

SEQ ID NO: 116610 - DNA, 25 bp, mus musculus
gcatttccaagtctgagttagttgc

SEQ ID NO: 116611 - DNA, 25 bp, mus musculus
tttccaagtctgagttagttgccat

SEQ ID NO: 116612 - DNA, 25 bp, mus musculus
ccaaaggcactggccttgatgaggc

SEQ ID NO: 116613 - DNA, 25 bp, mus musculus
aaggcactggccttgatgaggcaat

SEQ ID NO: 116614 - DNA, 25 bp, mus musculus
gcactggccttgatgaggcaatgga

SEQ ID NO: 116615 - DNA, 25 bp, mus musculus
ttgaaaccctgaaaagcagacagtg

SEQ ID NO: 116616 - DNA, 25 bp, mus musculus
aaaccctgaaaagcagacagtgagc

SEQ ID NO: 116617 - DNA, 25 bp, mus musculus
gacagtgagcccattcacgtcagcg

SEQ ID NO: 116618 - DNA, 25 bp, mus musculus
agtgagcccattcacgtcagcgcct

SEQ ID NO: 116619 - DNA, 25 bp, mus musculus
attcacgtcagcgcctgtgagccaa

SEQ ID NO: 116620 - DNA, 25 bp, mus musculus
gcctgtgagccaacgctacatcaca

SEQ ID NO: 116621 - DNA, 25 bp, mus musculus
tgtgagccaacgctacatcacatac

SEQ ID NO: 116622 - DNA, 25 bp, mus musculus
tagttgccatgttggaggaagaaga

SEQ ID NO: 116623 - DNA, 25 bp, mus musculus
gagccaacgctacatcacatactca

SEQ ID NO: 116624 - DNA, 25 bp, mus musculus
tggcaaatgctcttgggttacctgc

SEQ ID NO: 116625 - DNA, 25 bp, mus musculus
atgctcttgggttacctgccctgaa

SEQ ID NO: 116626 - DNA, 25 bp, mus musculus
ctgccctgaaggaccggaagtggca

SEQ ID NO: 116627 - DNA, 25 bp, mus musculus
ccctgaaggaccggaagtggcagat

SEQ ID NO: 116628 - DNA, 25 bp, mus musculus
aaacttcagcaaccaaaggcactgg

SEQ ID NO: 116629 - DNA, 25 bp, mus musculus
cttcagcaaccaaaggcactggcct

SEQ ID NO: 116630 - DNA, 25 bp, mus musculus
cagcaaccaaaggcactggccttga

SEQ ID NO: 116631 - DNA, 25 bp, mus musculus
ggctccagataaacttgccatccat

SEQ ID NO: 116632 - DNA, 25 bp, mus musculus
catccatcctgtgaaaggtgacagg

SEQ ID NO: 116633 - DNA, 25 bp, mus musculus
tttgagatttctcgtgtgaatcaga

SEQ ID NO: 116634 - DNA, 25 bp, mus musculus
atttctcgtgtgaatcagagtagcc

SEQ ID NO: 116635 - DNA, 25 bp, mus musculus
aatcagagtagcctcacttggtcag

SEQ ID NO: 116636 - DNA, 25 bp, mus musculus
tggtcagttctgggtccctggtctc

SEQ ID NO: 116637 - DNA, 25 bp, mus musculus
ggtccctggtctctgactctgcctt

SEQ ID NO: 116638 - DNA, 25 bp, mus musculus
ctgactctgcctttctgctgcctcg

SEQ ID NO: 116639 - DNA, 25 bp, mus musculus
tgtatctaatgtcgatccccttagg

SEQ ID NO: 116640 - DNA, 25 bp, mus musculus
aatgtacatctgcttttgtatgcac

SEQ ID NO: 116641 - DNA, 25 bp, mus musculus
cttttgtatgcactcattaaacatt

SEQ ID NO: 116642 - DNA, 25 bp, mus musculus
tatgcactcattaaacattgtaaca

SEQ ID NO: 116643 - DNA, 25 bp, mus musculus
accgtcattgtcattgccttcagat

SEQ ID NO: 116644 - DNA, 25 bp, mus musculus
attgtcattgccttcagataagaga

SEQ ID NO: 116645 - DNA, 25 bp, mus musculus
attgccttcagataagagagaactc

SEQ ID NO: 116646 - DNA, 25 bp, mus musculus
tccagtccacttgccaagagtttcc

SEQ ID NO: 116647 - DNA, 25 bp, mus musculus
ccacttgccaagagtttcccagaga

SEQ ID NO: 116648 - DNA, 25 bp, mus musculus
gagtcagcccgggatggacacacta

SEQ ID NO: 116649 - DNA, 25 bp, mus musculus
cacactaacatctgtgtccaagttc

SEQ ID NO: 116650 - DNA, 25 bp, mus musculus
caagttcacacttttgagatttctc

SEQ ID NO: 116651 - DNA, 25 bp, mus musculus
agaactgcagtcagcctgaagcctg

SEQ ID NO: 116652 - DNA, 25 bp, mus musculus
gcagtcagcctgaagcctgtccaga

SEQ ID NO: 116653 - DNA, 25 bp, mus musculus
aaggctctacagcggatgctcttgg

SEQ ID NO: 116654 - DNA, 25 bp, mus musculus
gttacttgccacagactgtaagaca

SEQ ID NO: 116655 - DNA, 25 bp, mus musculus
gctacatgccgcagtgaaggactgg

SEQ ID NO: 116656 - DNA, 25 bp, mus musculus
ggactggctcctgaacttcagcagg

SEQ ID NO: 116657 - DNA, 25 bp, mus musculus
gaacttcagcaggaactgcaaaata

SEQ ID NO: 116658 - DNA, 25 bp, mus musculus
atgagaaacagtcctcactccctga

SEQ ID NO: 116659 - DNA, 25 bp, mus musculus
cctcactccctgaagataggcattg

SEQ ID NO: 116660 - DNA, 25 bp, mus musculus
aaagtcacacctgggccgtctccat

SEQ ID NO: 116661 - DNA, 25 bp, mus musculus
acacctgggccgtctccattccaga

SEQ ID NO: 116662 - DNA, 25 bp, mus musculus
gggccgtctccattccagagtagct

SEQ ID NO: 116663 - DNA, 25 bp, mus musculus
agcctgaagcctgtccagagatttc

SEQ ID NO: 116664 - DNA, 25 bp, mus musculus
ctccattccagagtagctggaattc

SEQ ID NO: 116665 - DNA, 25 bp, mus musculus
ttttgtccggcaatgaggaggattt

SEQ ID NO: 116666 - DNA, 25 bp, mus musculus
ttgtcagactgaagcagcagcaggt

SEQ ID NO: 116667 - DNA, 25 bp, mus musculus
atcacatttctcagccctatggatc

SEQ ID NO: 116668 - DNA, 25 bp, mus musculus
tttctcagccctatggatccgagca

SEQ ID NO: 116669 - DNA, 25 bp, mus musculus
agccctatggatccgagcaacggag

SEQ ID NO: 116670 - DNA, 25 bp, mus musculus
atggatccgagcaacggaggctgtt

SEQ ID NO: 116671 - DNA, 25 bp, mus musculus
ttcaggaaggctctacagcggatgc

SEQ ID NO: 116672 - DNA, 25 bp, mus musculus
aggtgcacagactttgccgtcctgc

SEQ ID NO: 116673 - DNA, 25 bp, mus musculus
gtgcacagactttgccgtcctgcct

SEQ ID NO: 116674 - DNA, 25 bp, mus musculus
tgttggcgccacataactgatcctt

SEQ ID NO: 116675 - DNA, 25 bp, mus musculus
gttggcgccacataactgatccttt

SEQ ID NO: 116676 - DNA, 25 bp, mus musculus
ttggcgccacataactgatcctttc

SEQ ID NO: 116677 - DNA, 25 bp, mus musculus
tggcgccacataactgatcctttca

SEQ ID NO: 116678 - DNA, 25 bp, mus musculus
ggcgccacataactgatcctttcaa

SEQ ID NO: 116679 - DNA, 25 bp, mus musculus
gcgccacataactgatcctttcaag

SEQ ID NO: 116680 - DNA, 25 bp, mus musculus
cgccacataactgatcctttcaagc

SEQ ID NO: 116681 - DNA, 25 bp, mus musculus
gccacataactgatcctttcaagca

SEQ ID NO: 116682 - DNA, 25 bp, mus musculus
tgcacagactttgccgtcctgccta

SEQ ID NO: 116683 - DNA, 25 bp, mus musculus
gcacagactttgccgtcctgcctag

SEQ ID NO: 116684 - DNA, 25 bp, mus musculus
cacagactttgccgtcctgcctagc

SEQ ID NO: 116685 - DNA, 25 bp, mus musculus
acagactttgccgtcctgcctagct

SEQ ID NO: 116686 - DNA, 25 bp, mus musculus
gtcctgcctagctctcctcacgaag

SEQ ID NO: 116687 - DNA, 25 bp, mus musculus
tcctgcctagctctcctcacgaagt

SEQ ID NO: 116688 - DNA, 25 bp, mus musculus
gatgttggcgccacataactgatcc

SEQ ID NO: 116689 - DNA, 25 bp, mus musculus
atgttggcgccacataactgatcct

SEQ ID NO: 116690 - DNA, 25 bp, mus musculus
cagtcctaagcatccactgtgcctt

SEQ ID NO: 116691 - DNA, 25 bp, mus musculus
gtgccttcagttccgggaagacact

SEQ ID NO: 116692 - DNA, 25 bp, mus musculus
gagacctcatcctggatgctgagaa

SEQ ID NO: 116693 - DNA, 25 bp, mus musculus
gctcagccgctgtagaaccaagaac

SEQ ID NO: 116694 - DNA, 25 bp, mus musculus
tcagaccgaccagtttctaacacct

SEQ ID NO: 116695 - DNA, 25 bp, mus musculus
tgccttctgcttctcaggacagaca

SEQ ID NO: 116696 - DNA, 25 bp, mus musculus
ctgcttctcaggacagacagggaaa

SEQ ID NO: 116697 - DNA, 25 bp, mus musculus
taatcttaactgcttttatggggtg

SEQ ID NO: 116698 - DNA, 25 bp, mus musculus
gaagatatttccagtcttcgtgaca

SEQ ID NO: 116699 - DNA, 25 bp, mus musculus
actcagtgttgctgggacagagctg

SEQ ID NO: 116700 - DNA, 25 bp, mus musculus
gtgttggtacccaatacagtgtaga

SEQ ID NO: 116701 - DNA, 25 bp, mus musculus
gtacccaatacagtgtagacatctt

SEQ ID NO: 116702 - DNA, 25 bp, mus musculus
tccaaaccatctctaagcctccgat

SEQ ID NO: 116703 - DNA, 25 bp, mus musculus
ccatctctaagcctccgatgagttg

SEQ ID NO: 116704 - DNA, 25 bp, mus musculus
gaggagccacgtcctcatctcccta

SEQ ID NO: 116705 - DNA, 25 bp, mus musculus
ctccctaggactcaagccctcagat

SEQ ID NO: 116706 - DNA, 25 bp, mus musculus
aggactcaagccctcagatcagctg

SEQ ID NO: 116707 - DNA, 25 bp, mus musculus
ctcagatcagctgcatctttctgga

SEQ ID NO: 116708 - DNA, 25 bp, mus musculus
gcatctttctggataatagagacct

SEQ ID NO: 116709 - DNA, 25 bp, mus musculus
ataatagagacctcatcctggatgc

SEQ ID NO: 116710 - DNA, 25 bp, mus musculus
tttgcactggccctgttccaaagtt

SEQ ID NO: 116711 - DNA, 25 bp, mus musculus
tgtcacagatcagcagcctggagcg

SEQ ID NO: 116712 - DNA, 25 bp, mus musculus
catcgatcccgactgggctggaacc

SEQ ID NO: 116713 - DNA, 25 bp, mus musculus
acgcatgactcaattcagagctgtt

SEQ ID NO: 116714 - DNA, 25 bp, mus musculus
attcagagctgttcctcgggagact

SEQ ID NO: 116715 - DNA, 25 bp, mus musculus
aacaccttaacctatgtttgctcag

SEQ ID NO: 116716 - DNA, 25 bp, mus musculus
tatgtttgctcagtcagtcaactgt

SEQ ID NO: 116717 - DNA, 25 bp, mus musculus
tgctcagtcagtcaactgtgaatct

SEQ ID NO: 116718 - DNA, 25 bp, mus musculus
gtcagtcaactgtgaatctgaggtc

SEQ ID NO: 116719 - DNA, 25 bp, mus musculus
tgaggtcttctgtcaggccacttgt

SEQ ID NO: 116720 - DNA, 25 bp, mus musculus
cttctgtcaggccacttgtctaccc

SEQ ID NO: 116721 - DNA, 25 bp, mus musculus
tcaggccacttgtctacccaataaa

SEQ ID NO: 116722 - DNA, 25 bp, mus musculus
tctctctccaccaggggtctccatt

SEQ ID NO: 116723 - DNA, 25 bp, mus musculus
aggggtctccatttcctgtgtggca

SEQ ID NO: 116724 - DNA, 25 bp, mus musculus
ctccatttcctgtgtggcagcaact

SEQ ID NO: 116725 - DNA, 25 bp, mus musculus
ttcctgtgtggcagcaactgggaca

SEQ ID NO: 116726 - DNA, 25 bp, mus musculus
gctctggccagcttgatattaaact

SEQ ID NO: 116727 - DNA, 25 bp, mus musculus
ttaaactaacacattaaggtgccag

SEQ ID NO: 116728 - DNA, 25 bp, mus musculus
taacacattaaggtgccaggcccct

SEQ ID NO: 116729 - DNA, 25 bp, mus musculus
tctctgctcctagcctttaagaatt

SEQ ID NO: 116730 - DNA, 25 bp, mus musculus
gaactcaagagcaccccagacagat

SEQ ID NO: 116731 - DNA, 25 bp, mus musculus
aagagcaccccagacagatcaagtt

SEQ ID NO: 116732 - DNA, 25 bp, mus musculus
accctgatcttaagaccagatcttt

SEQ ID NO: 116733 - DNA, 25 bp, mus musculus
ttaagaccagatctttcttacgagg

SEQ ID NO: 116734 - DNA, 25 bp, mus musculus
agaccagatctttcttacgaggtag

SEQ ID NO: 116735 - DNA, 25 bp, mus musculus
ccagatctttcttacgaggtagaag

SEQ ID NO: 116736 - DNA, 25 bp, mus musculus
gatctttcttacgaggtagaagtcg

SEQ ID NO: 116737 - DNA, 25 bp, mus musculus
gtcgatggccagtccattgagtctg

SEQ ID NO: 116738 - DNA, 25 bp, mus musculus
gatggccagtccattgagtctggca

SEQ ID NO: 116739 - DNA, 25 bp, mus musculus
cagtccattgagtctggcagcattg

SEQ ID NO: 116740 - DNA, 25 bp, mus musculus
attgagtctggcagcattgagtatg

SEQ ID NO: 116741 - DNA, 25 bp, mus musculus
gactggaacctgacatcgctgagga

SEQ ID NO: 116742 - DNA, 25 bp, mus musculus
agcaccccagacagatcaagttact

SEQ ID NO: 116743 - DNA, 25 bp, mus musculus
tcaagttactgttcccttggggcag

SEQ ID NO: 116744 - DNA, 25 bp, mus musculus
tgcttaggacctgatatttgtggat

SEQ ID NO: 116745 - DNA, 25 bp, mus musculus
aagccaatcagatgcaaggtggatg

SEQ ID NO: 116746 - DNA, 25 bp, mus musculus
gatggcttcacgcatctctacaccc

SEQ ID NO: 116747 - DNA, 25 bp, mus musculus
ttcacgcatctctacaccctgatct

SEQ ID NO: 116748 - DNA, 25 bp, mus musculus
acgcatctctacaccctgatcttaa

SEQ ID NO: 116749 - DNA, 25 bp, mus musculus
tacaccctgatcttaagaccagatc

SEQ ID NO: 116750 - DNA, 25 bp, mus musculus
ggccagcctaagctacaagatatca

SEQ ID NO: 116751 - DNA, 25 bp, mus musculus
tactctaattcaccaaaggatatgg

SEQ ID NO: 116752 - DNA, 25 bp, mus musculus
tgccaggatcggggacttgtcctga

SEQ ID NO: 116753 - DNA, 25 bp, mus musculus
ggacttgtcctgattctgcataagt

SEQ ID NO: 116754 - DNA, 25 bp, mus musculus
gtcctgattctgcataagtgctcct

SEQ ID NO: 116755 - DNA, 25 bp, mus musculus
attctgcataagtgctcctttctgt

SEQ ID NO: 116756 - DNA, 25 bp, mus musculus
tgtgatcttcacggggtcagctagt

SEQ ID NO: 116757 - DNA, 25 bp, mus musculus
cttcacggggtcagctagtgcttat

SEQ ID NO: 116758 - DNA, 25 bp, mus musculus
gggatgcctttcatcatcgaagagt

SEQ ID NO: 116759 - DNA, 25 bp, mus musculus
cctttcatcatcgaagagtaggacc

SEQ ID NO: 116760 - DNA, 25 bp, mus musculus
ggattcttcaacttcagaactagac

SEQ ID NO: 116761 - DNA, 25 bp, mus musculus
ttcaacttcagaactagacatatta

SEQ ID NO: 116762 - DNA, 25 bp, mus musculus
aattcaccaaaggatatggggatag

SEQ ID NO: 116763 - DNA, 25 bp, mus musculus
cagacaatctagtttgctcctctga

SEQ ID NO: 116764 - DNA, 25 bp, mus musculus
atctagtttgctcctctgaaactgt

SEQ ID NO: 116765 - DNA, 25 bp, mus musculus
tttgctcctctgaaactgtgtgtct

SEQ ID NO: 116766 - DNA, 25 bp, mus musculus
tgccttgtcagttcctgaggtcttt

SEQ ID NO: 116767 - DNA, 25 bp, mus musculus
ttaattcggtcttcatctctgtctc

SEQ ID NO: 116768 - DNA, 25 bp, mus musculus
gcatctccctgatgccaggatcggg

SEQ ID NO: 116769 - DNA, 25 bp, mus musculus
ccctgatgccaggatcggggacttg

SEQ ID NO: 116770 - DNA, 25 bp, mus musculus
tcctgtgctcctaagtcaacctagt

SEQ ID NO: 116771 - DNA, 25 bp, mus musculus
cctgtgctcctaagtcaacctagtg

SEQ ID NO: 116772 - DNA, 25 bp, mus musculus
ttttccacatctccatttgggtgtt

SEQ ID NO: 116773 - DNA, 25 bp, mus musculus
cacatctccatttgggtgttagcgc

SEQ ID NO: 116774 - DNA, 25 bp, mus musculus
acatctccatttgggtgttagcgca

SEQ ID NO: 116775 - DNA, 25 bp, mus musculus
catctccatttgggtgttagcgcaa

SEQ ID NO: 116776 - DNA, 25 bp, mus musculus
atctccatttgggtgttagcgcaag

SEQ ID NO: 116777 - DNA, 25 bp, mus musculus
tctccatttgggtgttagcgcaaga

SEQ ID NO: 116778 - DNA, 25 bp, mus musculus
ctccatttgggtgttagcgcaagat

SEQ ID NO: 116779 - DNA, 25 bp, mus musculus
tccatttgggtgttagcgcaagatt

SEQ ID NO: 116780 - DNA, 25 bp, mus musculus
catttgggtgttagcgcaagatttc

SEQ ID NO: 116781 - DNA, 25 bp, mus musculus
gatttcagctagttggctgagattg

SEQ ID NO: 116782 - DNA, 25 bp, mus musculus
ctgtgctcctaagtcaacctagtgt

SEQ ID NO: 116783 - DNA, 25 bp, mus musculus
atttcagctagttggctgagattgg

SEQ ID NO: 116784 - DNA, 25 bp, mus musculus
tgtgctcctaagtcaacctagtgtt

SEQ ID NO: 116785 - DNA, 25 bp, mus musculus
gtgctcctaagtcaacctagtgttt

SEQ ID NO: 116786 - DNA, 25 bp, mus musculus
tgctcctaagtcaacctagtgtttt

SEQ ID NO: 116787 - DNA, 25 bp, mus musculus
taagtcaacctagtgttttccacat

SEQ ID NO: 116788 - DNA, 25 bp, mus musculus
agtcaacctagtgttttccacatct

SEQ ID NO: 116789 - DNA, 25 bp, mus musculus
gtcaacctagtgttttccacatctc

SEQ ID NO: 116790 - DNA, 25 bp, mus musculus
tcaacctagtgttttccacatctcc

SEQ ID NO: 116791 - DNA, 25 bp, mus musculus
gtggctacactgcagtctagacact

SEQ ID NO: 116792 - DNA, 25 bp, mus musculus
acactgcagtctagacactaagata

SEQ ID NO: 116793 - DNA, 25 bp, mus musculus
ttcagaggccagatccacgttgtca

SEQ ID NO: 116794 - DNA, 25 bp, mus musculus
ggccagatccacgttgtcacagtac

SEQ ID NO: 116795 - DNA, 25 bp, mus musculus
cgctcgctacctgcatgcctttgtg

SEQ ID NO: 116796 - DNA, 25 bp, mus musculus
ctttgtggctcatggtttctgggtg

SEQ ID NO: 116797 - DNA, 25 bp, mus musculus
ggctcatggtttctgggtgccttta

SEQ ID NO: 116798 - DNA, 25 bp, mus musculus
ggctaaaatgcactcttagtgtttt

SEQ ID NO: 116799 - DNA, 25 bp, mus musculus
aatgcactcttagtgttttccaata

SEQ ID NO: 116800 - DNA, 25 bp, mus musculus
cactatctttatgttgctgcgaatg

SEQ ID NO: 116801 - DNA, 25 bp, mus musculus
ctttatgttgctgcgaatgccttag

SEQ ID NO: 116802 - DNA, 25 bp, mus musculus
gacttaacttcaaaattgtatctga

SEQ ID NO: 116803 - DNA, 25 bp, mus musculus
aaatgcttgtgccatggccactaca

SEQ ID NO: 116804 - DNA, 25 bp, mus musculus
cactacattaccacagcttctcatc

SEQ ID NO: 116805 - DNA, 25 bp, mus musculus
attaccacagcttctcatcttcagt

SEQ ID NO: 116806 - DNA, 25 bp, mus musculus
acagcttctcatcttcagtgcactc

SEQ ID NO: 116807 - DNA, 25 bp, mus musculus
tctcatcttcagtgcactcatttct

SEQ ID NO: 116808 - DNA, 25 bp, mus musculus
tgctctttctatcccaagccgaaga

SEQ ID NO: 116809 - DNA, 25 bp, mus musculus
acttcaatagtcttcagaggccaga

SEQ ID NO: 116810 - DNA, 25 bp, mus musculus
atagtcttcagaggccagatccacg

SEQ ID NO: 116811 - DNA, 25 bp, mus musculus
gcagctaactccaagtcagctgatg

SEQ ID NO: 116812 - DNA, 25 bp, mus musculus
gctaactccaagtcagctgatgggt

SEQ ID NO: 116813 - DNA, 25 bp, mus musculus
tattcagcttgctaaagatgatagg

SEQ ID NO: 116814 - DNA, 25 bp, mus musculus
aagtgatctcatccgtcgaagtgtg

SEQ ID NO: 116815 - DNA, 25 bp, mus musculus
tgatctcatccgtcgaagtgtgaaa

SEQ ID NO: 116816 - DNA, 25 bp, mus musculus
tctcatccgtcgaagtgtgaaacga

SEQ ID NO: 116817 - DNA, 25 bp, mus musculus
gaaacgatccggagacatctctgag

SEQ ID NO: 116818 - DNA, 25 bp, mus musculus
acgatccggagacatctctgagcat

SEQ ID NO: 116819 - DNA, 25 bp, mus musculus
atccggagacatctctgagcattaa

SEQ ID NO: 116820 - DNA, 25 bp, mus musculus
cggagacatctctgagcattaagat

SEQ ID NO: 116821 - DNA, 25 bp, mus musculus
agacatctctgagcattaagatgga

SEQ ID NO: 116822 - DNA, 25 bp, mus musculus
catctctgagcattaagatggaaga

SEQ ID NO: 116823 - DNA, 25 bp, mus musculus
tccaagtcagctgatgggtatggag

SEQ ID NO: 116824 - DNA, 25 bp, mus musculus
aagtcagctgatgggtatggagaag

SEQ ID NO: 116825 - DNA, 25 bp, mus musculus
accaaaaagacctcgttcagcatat

SEQ ID NO: 116826 - DNA, 25 bp, mus musculus
aagacctcgttcagcatataacatt

SEQ ID NO: 116827 - DNA, 25 bp, mus musculus
acctcgttcagcatataacatttat

SEQ ID NO: 116828 - DNA, 25 bp, mus musculus
tgtatctgaaagcttccaggaggca

SEQ ID NO: 116829 - DNA, 25 bp, mus musculus
ggatgattcggctcagggaaaattg

SEQ ID NO: 116830 - DNA, 25 bp, mus musculus
tgattcggctcagggaaaattgaag

SEQ ID NO: 116831 - DNA, 25 bp, mus musculus
acgattgactcgacaacatatcatg

SEQ ID NO: 116832 - DNA, 25 bp, mus musculus
gactcgacaacatatcatgagacat

SEQ ID NO: 116833 - DNA, 25 bp, mus musculus
ttcaccagaagaacgtggtagtaat

SEQ ID NO: 116834 - DNA, 25 bp, mus musculus
taatgccaggccaatgaaaacgctc

SEQ ID NO: 116835 - DNA, 25 bp, mus musculus
aatgaaaacgctcaactggcaatca

SEQ ID NO: 116836 - DNA, 25 bp, mus musculus
aacgctcaactggcaatcaccacga

SEQ ID NO: 116837 - DNA, 25 bp, mus musculus
caactggcaatcaccacgaaaagtc

SEQ ID NO: 116838 - DNA, 25 bp, mus musculus
gcaatcaccacgaaaagtctttcag

SEQ ID NO: 116839 - DNA, 25 bp, mus musculus
gaaacatgcggtgttcggatgattc

SEQ ID NO: 116840 - DNA, 25 bp, mus musculus
atgattcttgcaatctaccatttaa

SEQ ID NO: 116841 - DNA, 25 bp, mus musculus
gttaatctctttggaagcgtcaaga

SEQ ID NO: 116842 - DNA, 25 bp, mus musculus
ctctttggaagcgtcaagaatcttg

SEQ ID NO: 116843 - DNA, 25 bp, mus musculus
agtgacaccagctattattaggttt

SEQ ID NO: 116844 - DNA, 25 bp, mus musculus
atcaattacagttgatcacggtcga

SEQ ID NO: 116845 - DNA, 25 bp, mus musculus
tgatcacggtcgagagtttgcaaaa

SEQ ID NO: 116846 - DNA, 25 bp, mus musculus
acagctaggcataccgatgtatttt

SEQ ID NO: 116847 - DNA, 25 bp, mus musculus
aggcataccgatgtattttgcacac

SEQ ID NO: 116848 - DNA, 25 bp, mus musculus
gtattttgcacacccatattcacca

SEQ ID NO: 116849 - DNA, 25 bp, mus musculus
tgcacacccatattcaccagaagaa

SEQ ID NO: 116850 - DNA, 25 bp, mus musculus
cccatattcaccagaagaacgtggt

SEQ ID NO: 116851 - DNA, 25 bp, mus musculus
agcctttctaaaacatctcaacagt

SEQ ID NO: 116852 - DNA, 25 bp, mus musculus
acatctcaacagtgagcatgcgctg

SEQ ID NO: 116853 - DNA, 25 bp, mus musculus
ccacctgcatgtgaagtctacagaa

SEQ ID NO: 116854 - DNA, 25 bp, mus musculus
gaagtctacagaacccaaagctgcc

SEQ ID NO: 116855 - DNA, 25 bp, mus musculus
tcagcccctgaatctggtatcaagt

SEQ ID NO: 116856 - DNA, 25 bp, mus musculus
gcccctgaatctggtatcaagtgtc

SEQ ID NO: 116857 - DNA, 25 bp, mus musculus
ctccaagtctgcctcagaggcttct

SEQ ID NO: 116858 - DNA, 25 bp, mus musculus
caagtctgcctcagaggcttctcca

SEQ ID NO: 116859 - DNA, 25 bp, mus musculus
ctcagaggcttctccacagagctta

SEQ ID NO: 116860 - DNA, 25 bp, mus musculus
agaggcttctccacagagcttacct

SEQ ID NO: 116861 - DNA, 25 bp, mus musculus
ggcttctccacagagcttacctcat

SEQ ID NO: 116862 - DNA, 25 bp, mus musculus
tccacagagcttacctcatactcca

SEQ ID NO: 116863 - DNA, 25 bp, mus musculus
caacagtgagcatgcgctggacgat

SEQ ID NO: 116864 - DNA, 25 bp, mus musculus
aagcacagctcaatgtagagtacaa

SEQ ID NO: 116865 - DNA, 25 bp, mus musculus
gctacagcttgcaaaagacaaagag

SEQ ID NO: 116866 - DNA, 25 bp, mus musculus
agacaaagagcgcctgcaagccatg

SEQ ID NO: 116867 - DNA, 25 bp, mus musculus
agagcgcctgcaagccatgatgacc

SEQ ID NO: 116868 - DNA, 25 bp, mus musculus
gcgcctgcaagccatgatgacccac

SEQ ID NO: 116869 - DNA, 25 bp, mus musculus
cctgcaagccatgatgacccacctg

SEQ ID NO: 116870 - DNA, 25 bp, mus musculus
catgatgacccacctgcatgtgaag

SEQ ID NO: 116871 - DNA, 25 bp, mus musculus
aagtcaagcattatctcattttgcc

SEQ ID NO: 116872 - DNA, 25 bp, mus musculus
atctcattttgccaagtgaagatga

SEQ ID NO: 116873 - DNA, 25 bp, mus musculus
tggccctctgaggccgcacaagcta

SEQ ID NO: 116874 - DNA, 25 bp, mus musculus
gccgcacaagctactgcagccatgg

SEQ ID NO: 116875 - DNA, 25 bp, mus musculus
caagctactgcagccatgggtttgc

SEQ ID NO: 116876 - DNA, 25 bp, mus musculus
acccttctgtcctgtggactcggtg

SEQ ID NO: 116877 - DNA, 25 bp, mus musculus
gactcctgtccccaagggaggcatt

SEQ ID NO: 116878 - DNA, 25 bp, mus musculus
cctgtccccttggtagagctcctga

SEQ ID NO: 116879 - DNA, 25 bp, mus musculus
cccttggtagagctcctgaggtact

SEQ ID NO: 116880 - DNA, 25 bp, mus musculus
ctcctgaggtactgttccagtgagg

SEQ ID NO: 116881 - DNA, 25 bp, mus musculus
cataatctgtacagactgagaggcc

SEQ ID NO: 116882 - DNA, 25 bp, mus musculus
atctgctctgttttataccagtaac

SEQ ID NO: 116883 - DNA, 25 bp, mus musculus
gcctttacttcagcatggatgaggg

SEQ ID NO: 116884 - DNA, 25 bp, mus musculus
acttcagcatggatgagggccagac

SEQ ID NO: 116885 - DNA, 25 bp, mus musculus
cccgtttcacagacctgctgcagct

SEQ ID NO: 116886 - DNA, 25 bp, mus musculus
acctgctgcagctggtagaattcca

SEQ ID NO: 116887 - DNA, 25 bp, mus musculus
aattccaccagctgaaccgaggcat

SEQ ID NO: 116888 - DNA, 25 bp, mus musculus
accagctgaaccgaggcatcctgcc

SEQ ID NO: 116889 - DNA, 25 bp, mus musculus
tgaaccgaggcatcctgccctgcct

SEQ ID NO: 116890 - DNA, 25 bp, mus musculus
gccactgctgtgcccgtgtggccct

SEQ ID NO: 116891 - DNA, 25 bp, mus musculus
tataggctgggctggagcggaaata

SEQ ID NO: 116892 - DNA, 25 bp, mus musculus
cacaggcccattcagtccacacaaa

SEQ ID NO: 116893 - DNA, 25 bp, mus musculus
attcagtccacacaaagaagcttag

SEQ ID NO: 116894 - DNA, 25 bp, mus musculus
ttcagtccacacaaagaagcttagt

SEQ ID NO: 116895 - DNA, 25 bp, mus musculus
tcagtccacacaaagaagcttagta

SEQ ID NO: 116896 - DNA, 25 bp, mus musculus
cagtccacacaaagaagcttagtat

SEQ ID NO: 116897 - DNA, 25 bp, mus musculus
agtccacacaaagaagcttagtatt

SEQ ID NO: 116898 - DNA, 25 bp, mus musculus
gtccacacaaagaagcttagtattt

SEQ ID NO: 116899 - DNA, 25 bp, mus musculus
tccacacaaagaagcttagtatttt

SEQ ID NO: 116900 - DNA, 25 bp, mus musculus
acaggcccattcagtccacacaaag

SEQ ID NO: 116901 - DNA, 25 bp, mus musculus
caggcccattcagtccacacaaaga

SEQ ID NO: 116902 - DNA, 25 bp, mus musculus
aggcccattcagtccacacaaagaa

SEQ ID NO: 116903 - DNA, 25 bp, mus musculus
ggcccattcagtccacacaaagaag

SEQ ID NO: 116904 - DNA, 25 bp, mus musculus
gcccattcagtccacacaaagaagc

SEQ ID NO: 116905 - DNA, 25 bp, mus musculus
cccattcagtccacacaaagaagct

SEQ ID NO: 116906 - DNA, 25 bp, mus musculus
ccattcagtccacacaaagaagctt

SEQ ID NO: 116907 - DNA, 25 bp, mus musculus
cattcagtccacacaaagaagctta

SEQ ID NO: 116908 - DNA, 25 bp, mus musculus
ctatgtttaagcctactacaagtgt

SEQ ID NO: 116909 - DNA, 25 bp, mus musculus
ttttatgattacctctctgaactat

SEQ ID NO: 116910 - DNA, 25 bp, mus musculus
catagatccaatattgactgaccca

SEQ ID NO: 116911 - DNA, 25 bp, mus musculus
tccaatattgactgacccaagcatg

SEQ ID NO: 116912 - DNA, 25 bp, mus musculus
atattgactgacccaagcatgttat

SEQ ID NO: 116913 - DNA, 25 bp, mus musculus
attgactgacccaagcatgttataa

SEQ ID NO: 116914 - DNA, 25 bp, mus musculus
tgactgacccaagcatgttataaag

SEQ ID NO: 116915 - DNA, 25 bp, mus musculus
actgacccaagcatgttataaagac

SEQ ID NO: 116916 - DNA, 25 bp, mus musculus
tgacccaagcatgttataaagactg

SEQ ID NO: 116917 - DNA, 25 bp, mus musculus
aatatatccaaagcactataggcat

SEQ ID NO: 116918 - DNA, 25 bp, mus musculus
tatccaaagcactataggcattaga

SEQ ID NO: 116919 - DNA, 25 bp, mus musculus
tccaaagcactataggcattagaat

SEQ ID NO: 116920 - DNA, 25 bp, mus musculus
ttatgattacctctctgaactatgg

SEQ ID NO: 116921 - DNA, 25 bp, mus musculus
atgattacctctctgaactatggtg

SEQ ID NO: 116922 - DNA, 25 bp, mus musculus
gattacctctctgaactatggtgtg

SEQ ID NO: 116923 - DNA, 25 bp, mus musculus
ttacctctctgaactatggtgtgaa

SEQ ID NO: 116924 - DNA, 25 bp, mus musculus
acctctctgaactatggtgtgaaca

SEQ ID NO: 116925 - DNA, 25 bp, mus musculus
ctctctgaactatggtgtgaacaat

SEQ ID NO: 116926 - DNA, 25 bp, mus musculus
tttacgcataaagcagactgcatag

SEQ ID NO: 116927 - DNA, 25 bp, mus musculus
actgcatagatccaatattgactga

SEQ ID NO: 116928 - DNA, 25 bp, mus musculus
atgagactcccaggagttactcgct

SEQ ID NO: 116929 - DNA, 25 bp, mus musculus
gagactcccaggagttactcgctga

SEQ ID NO: 116930 - DNA, 25 bp, mus musculus
tctcctccatctaaggtcccagtga

SEQ ID NO: 116931 - DNA, 25 bp, mus musculus
tcctccatctaaggtcccagtgatc

SEQ ID NO: 116932 - DNA, 25 bp, mus musculus
ctccatctaaggtcccagtgatctc

SEQ ID NO: 116933 - DNA, 25 bp, mus musculus
ccatctaaggtcccagtgatctctg

SEQ ID NO: 116934 - DNA, 25 bp, mus musculus
ttaagctgcatacgaacacttctgc

SEQ ID NO: 116935 - DNA, 25 bp, mus musculus
aagctgcatacgaacacttctgctt

SEQ ID NO: 116936 - DNA, 25 bp, mus musculus
gctgcatacgaacacttctgcttgt

SEQ ID NO: 116937 - DNA, 25 bp, mus musculus
tgcatacgaacacttctgcttgtgt

SEQ ID NO: 116938 - DNA, 25 bp, mus musculus
catacgaacacttctgcttgtgtta

SEQ ID NO: 116939 - DNA, 25 bp, mus musculus
cacttctgcttgtgttaggaagcta

SEQ ID NO: 116940 - DNA, 25 bp, mus musculus
ctcccaggagttactcgctgaggtc

SEQ ID NO: 116941 - DNA, 25 bp, mus musculus
cccaggagttactcgctgaggtctg

SEQ ID NO: 116942 - DNA, 25 bp, mus musculus
tcgctgaggtctgtggatttgtaat

SEQ ID NO: 116943 - DNA, 25 bp, mus musculus
atttgtaatgtctttctcctccatc

SEQ ID NO: 116944 - DNA, 25 bp, mus musculus
ttgtaatgtctttctcctccatcta

SEQ ID NO: 116945 - DNA, 25 bp, mus musculus
gtaatgtctttctcctccatctaag

SEQ ID NO: 116946 - DNA, 25 bp, mus musculus
aatgtctttctcctccatctaaggt

SEQ ID NO: 116947 - DNA, 25 bp, mus musculus
tctttctcctccatctaaggtccca

SEQ ID NO: 116948 - DNA, 25 bp, mus musculus
cagccacaaatgccttcatggccag

SEQ ID NO: 116949 - DNA, 25 bp, mus musculus
caaatgccttcatggccagtgactt

SEQ ID NO: 116950 - DNA, 25 bp, mus musculus
gaatcttgccaccatcgatggccgt

SEQ ID NO: 116951 - DNA, 25 bp, mus musculus
tggccgtgcacagttgttaagcttg

SEQ ID NO: 116952 - DNA, 25 bp, mus musculus
gcctcgcactccatcaggtccaaat

SEQ ID NO: 116953 - DNA, 25 bp, mus musculus
atcaggtccaaatgcattctcactg

SEQ ID NO: 116954 - DNA, 25 bp, mus musculus
tccaaatgcattctcactgaggtca

SEQ ID NO: 116955 - DNA, 25 bp, mus musculus
tgcattctcactgaggtcaagttct

SEQ ID NO: 116956 - DNA, 25 bp, mus musculus
aagttctaccagctgtgctcctaca

SEQ ID NO: 116957 - DNA, 25 bp, mus musculus
taccagctgtgctcctacagtgatg

SEQ ID NO: 116958 - DNA, 25 bp, mus musculus
ctgtgctcctacagtgatgagtcct

SEQ ID NO: 116959 - DNA, 25 bp, mus musculus
gagtccttccctagtgagatcagac

SEQ ID NO: 116960 - DNA, 25 bp, mus musculus
ccttcatggccagtgacttgcttta

SEQ ID NO: 116961 - DNA, 25 bp, mus musculus
gagatcagacctggttggatcccag

SEQ ID NO: 116962 - DNA, 25 bp, mus musculus
tggccagtgacttgctttaggcact

SEQ ID NO: 116963 - DNA, 25 bp, mus musculus
tgctttaggcactggacttgcggtg

SEQ ID NO: 116964 - DNA, 25 bp, mus musculus
aggcactggacttgcggtgacactc

SEQ ID NO: 116965 - DNA, 25 bp, mus musculus
tggacttgcggtgacactcagtcag

SEQ ID NO: 116966 - DNA, 25 bp, mus musculus
cagtcagagctgctgccagaatctt

SEQ ID NO: 116967 - DNA, 25 bp, mus musculus
gagctgctgccagaatcttgccacc

SEQ ID NO: 116968 - DNA, 25 bp, mus musculus
ctgccagaatcttgccaccatcgat

SEQ ID NO: 116969 - DNA, 25 bp, mus musculus
tgcagtcagctcaggggttgcattt

SEQ ID NO: 116970 - DNA, 25 bp, mus musculus
attccattggatcccatcaatccag

SEQ ID NO: 116971 - DNA, 25 bp, mus musculus
actgaggacccatatgctcaactgt

SEQ ID NO: 116972 - DNA, 25 bp, mus musculus
tatgctcaactgtatcatattggat

SEQ ID NO: 116973 - DNA, 25 bp, mus musculus
tcaagcttagcagtcaaggccatgt

SEQ ID NO: 116974 - DNA, 25 bp, mus musculus
ttagcagtcaaggccatgtttggcc

SEQ ID NO: 116975 - DNA, 25 bp, mus musculus
caccccatggtcaatgacgtggact

SEQ ID NO: 116976 - DNA, 25 bp, mus musculus
aatgacgtggactcctctcacctcc

SEQ ID NO: 116977 - DNA, 25 bp, mus musculus
cagcttctcagtttctgcctgggca

SEQ ID NO: 116978 - DNA, 25 bp, mus musculus
ctcagtttctgcctgggcaatggct

SEQ ID NO: 116979 - DNA, 25 bp, mus musculus
gtgaaccaggaccttgtatctgtct

SEQ ID NO: 116980 - DNA, 25 bp, mus musculus
caggaccttgtatctgtctgctctg

SEQ ID NO: 116981 - DNA, 25 bp, mus musculus
cccatcaatccagagtggctctacc

SEQ ID NO: 116982 - DNA, 25 bp, mus musculus
aatccagagtggctctaccactgtg

SEQ ID NO: 116983 - DNA, 25 bp, mus musculus
aaccacattgtgaaccgagagccac

SEQ ID NO: 116984 - DNA, 25 bp, mus musculus
aaccgagagccacattcttcaggtg

SEQ ID NO: 116985 - DNA, 25 bp, mus musculus
agtcaggaggccactgaccactggc

SEQ ID NO: 116986 - DNA, 25 bp, mus musculus
gaggccactgaccactggcatatca

SEQ ID NO: 116987 - DNA, 25 bp, mus musculus
cactggcatatcacagctgcacact

SEQ ID NO: 116988 - DNA, 25 bp, mus musculus
tcgtctccgttccctagcagacact

SEQ ID NO: 116989 - DNA, 25 bp, mus musculus
agtcatgactccagatatcttagct

SEQ ID NO: 116990 - DNA, 25 bp, mus musculus
gtcatgactccagatatcttagcta

SEQ ID NO: 116991 - DNA, 25 bp, mus musculus
gccaaagtatcggactcgggagcaa

SEQ ID NO: 116992 - DNA, 25 bp, mus musculus
ccaaagtatcggactcgggagcaag

SEQ ID NO: 116993 - DNA, 25 bp, mus musculus
gtatcggactcgggagcaagaaagt

SEQ ID NO: 116994 - DNA, 25 bp, mus musculus
tatcggactcgggagcaagaaagta

SEQ ID NO: 116995 - DNA, 25 bp, mus musculus
ctcccctgaggagcgagaaaagaag

SEQ ID NO: 116996 - DNA, 25 bp, mus musculus
aatttcaaaagacctacatgatgat

SEQ ID NO: 116997 - DNA, 25 bp, mus musculus
atttcaaaagacctacatgatgatg

SEQ ID NO: 116998 - DNA, 25 bp, mus musculus
ttcaaaagacctacatgatgatgat

SEQ ID NO: 116999 - DNA, 25 bp, mus musculus
tcaaaagacctacatgatgatgatg

SEQ ID NO: 117000 - DNA, 25 bp, mus musculus
agacctacatgatgatgatgaagat

SEQ ID NO: 117001 - DNA, 25 bp, mus musculus
catgactccagatatcttagctaag

SEQ ID NO: 117002 - DNA, 25 bp, mus musculus
gactccagatatcttagctaagaaa

SEQ ID NO: 117003 - DNA, 25 bp, mus musculus
gaaattagctgctgctgaaggctca

SEQ ID NO: 117004 - DNA, 25 bp, mus musculus
aaattagctgctgctgaaggctcag

SEQ ID NO: 117005 - DNA, 25 bp, mus musculus
attagctgctgctgaaggctcagag

SEQ ID NO: 117006 - DNA, 25 bp, mus musculus
ttagctgctgctgaaggctcagagc

SEQ ID NO: 117007 - DNA, 25 bp, mus musculus
agctgctgctgaaggctcagagcca

SEQ ID NO: 117008 - DNA, 25 bp, mus musculus
gctgctgctgaaggctcagagccaa

SEQ ID NO: 117009 - DNA, 25 bp, mus musculus
tgcttgcaaaacatggcttggctcc

SEQ ID NO: 117010 - DNA, 25 bp, mus musculus
ttttttccagaaatatctataatat

SEQ ID NO: 117011 - DNA, 25 bp, mus musculus
tggcttatgcccagatttcccattt

SEQ ID NO: 117012 - DNA, 25 bp, mus musculus
cttatgcccagatttcccatttcat

SEQ ID NO: 117013 - DNA, 25 bp, mus musculus
cccagatttcccatttcatagaaat

SEQ ID NO: 117014 - DNA, 25 bp, mus musculus
tttcccatttcatagaaattctgat

SEQ ID NO: 117015 - DNA, 25 bp, mus musculus
cccatttcatagaaattctgattct

SEQ ID NO: 117016 - DNA, 25 bp, mus musculus
atccaattttggtcattatagtgtc

SEQ ID NO: 117017 - DNA, 25 bp, mus musculus
ttatagtgtcattctaccatagaag

SEQ ID NO: 117018 - DNA, 25 bp, mus musculus
tagtgtcattctaccatagaagaga

SEQ ID NO: 117019 - DNA, 25 bp, mus musculus
tgtcattctaccatagaagagagat

SEQ ID NO: 117020 - DNA, 25 bp, mus musculus
cattctaccatagaagagagatctt

SEQ ID NO: 117021 - DNA, 25 bp, mus musculus
aagagtcccatgtgtgaggaatgga

SEQ ID NO: 117022 - DNA, 25 bp, mus musculus
agtcccatgtgtgaggaatggactc

SEQ ID NO: 117023 - DNA, 25 bp, mus musculus
actccatttataacattggaagcca

SEQ ID NO: 117024 - DNA, 25 bp, mus musculus
aatattgactttttcagagatgttg

SEQ ID NO: 117025 - DNA, 25 bp, mus musculus
caaccaaatgtagacccatgtatgg

SEQ ID NO: 117026 - DNA, 25 bp, mus musculus
aatgtagacccatgtatggctatgg

SEQ ID NO: 117027 - DNA, 25 bp, mus musculus
gtagacccatgtatggctatggagc

SEQ ID NO: 117028 - DNA, 25 bp, mus musculus
caatggcttatgcccagatttccca

SEQ ID NO: 117029 - DNA, 25 bp, mus musculus
agggccttgcgagcccagagcccag

SEQ ID NO: 117030 - DNA, 25 bp, mus musculus
cagagcccagcacacgctgcgcagg

SEQ ID NO: 117031 - DNA, 25 bp, mus musculus
aagtccctgctatgtggatatttgt

SEQ ID NO: 117032 - DNA, 25 bp, mus musculus
aaactacgtatcgcagatttcattg

SEQ ID NO: 117033 - DNA, 25 bp, mus musculus
aactacgtatcgcagatttcattgc

SEQ ID NO: 117034 - DNA, 25 bp, mus musculus
ctacgtatcgcagatttcattgctt

SEQ ID NO: 117035 - DNA, 25 bp, mus musculus
tacgtatcgcagatttcattgcttc

SEQ ID NO: 117036 - DNA, 25 bp, mus musculus
acgtatcgcagatttcattgcttca

SEQ ID NO: 117037 - DNA, 25 bp, mus musculus
gtatcgcagatttcattgcttcagg

SEQ ID NO: 117038 - DNA, 25 bp, mus musculus
tatcgcagatttcattgcttcagga

SEQ ID NO: 117039 - DNA, 25 bp, mus musculus
cctctgcaagtgggaacagccaatt

SEQ ID NO: 117040 - DNA, 25 bp, mus musculus
tttttcacaaagacagaaggtgaag

SEQ ID NO: 117041 - DNA, 25 bp, mus musculus
agagcccagcacacgctgcgcaggc

SEQ ID NO: 117042 - DNA, 25 bp, mus musculus
gagcccagcacacgctgcgcaggcg

SEQ ID NO: 117043 - DNA, 25 bp, mus musculus
gcccagcacacgctgcgcaggcggg

SEQ ID NO: 117044 - DNA, 25 bp, mus musculus
gcgtctctccatcctgaagtccctg

SEQ ID NO: 117045 - DNA, 25 bp, mus musculus
gtctctccatcctgaagtccctgct

SEQ ID NO: 117046 - DNA, 25 bp, mus musculus
tctctccatcctgaagtccctgcta

SEQ ID NO: 117047 - DNA, 25 bp, mus musculus
ctccatcctgaagtccctgctatgt

SEQ ID NO: 117048 - DNA, 25 bp, mus musculus
gaagtccctgctatgtggatatttg

SEQ ID NO: 117049 - DNA, 25 bp, mus musculus
aaggccttcggtcatggctcgttgc

SEQ ID NO: 117050 - DNA, 25 bp, mus musculus
gccttcggtcatggctcgttgctgg

SEQ ID NO: 117051 - DNA, 25 bp, mus musculus
tacccatgcccgcagtgcgcacagg

SEQ ID NO: 117052 - DNA, 25 bp, mus musculus
cagtgcgcacaggcctttgggcaga

SEQ ID NO: 117053 - DNA, 25 bp, mus musculus
tgcgcacaggcctttgggcagagct

SEQ ID NO: 117054 - DNA, 25 bp, mus musculus
gcacaggcctttgggcagagctcag

SEQ ID NO: 117055 - DNA, 25 bp, mus musculus
caggcctttgggcagagctcagcgt

SEQ ID NO: 117056 - DNA, 25 bp, mus musculus
gcctttgggcagagctcagcgttgc

SEQ ID NO: 117057 - DNA, 25 bp, mus musculus
tttgggcagagctcagcgttgctcc

SEQ ID NO: 117058 - DNA, 25 bp, mus musculus
cagagctcagcgttgctccagcatc

SEQ ID NO: 117059 - DNA, 25 bp, mus musculus
agctcagcgttgctccagcatcagc

SEQ ID NO: 117060 - DNA, 25 bp, mus musculus
actgctgagcgtccctaccgctgtc

SEQ ID NO: 117061 - DNA, 25 bp, mus musculus
ttcggtcatggctcgttgctggccc

SEQ ID NO: 117062 - DNA, 25 bp, mus musculus
cgtccccacaagtgcccagtgtgtg

SEQ ID NO: 117063 - DNA, 25 bp, mus musculus
ccccacaagtgcccagtgtgtgcca

SEQ ID NO: 117064 - DNA, 25 bp, mus musculus
cacaagtgcccagtgtgtgccaaag

SEQ ID NO: 117065 - DNA, 25 bp, mus musculus
aagtgcccagtgtgtgccaaaggct

SEQ ID NO: 117066 - DNA, 25 bp, mus musculus
cagggctctgcgctacttaaacacc

SEQ ID NO: 117067 - DNA, 25 bp, mus musculus
ggctctgcgctacttaaacacctgc

SEQ ID NO: 117068 - DNA, 25 bp, mus musculus
tctgcgctacttaaacacctgcgca

SEQ ID NO: 117069 - DNA, 25 bp, mus musculus
gtcactggccttgggcaagaagaga

SEQ ID NO: 117070 - DNA, 25 bp, mus musculus
agcagcggattctctcgttcacgct

SEQ ID NO: 117071 - DNA, 25 bp, mus musculus
tcctagatccattccactcggagtt

SEQ ID NO: 117072 - DNA, 25 bp, mus musculus
tagatccattccactcggagttggg

SEQ ID NO: 117073 - DNA, 25 bp, mus musculus
atccattccactcggagttgggaag

SEQ ID NO: 117074 - DNA, 25 bp, mus musculus
cattccactcggagttgggaagcag

SEQ ID NO: 117075 - DNA, 25 bp, mus musculus
tccactcggagttgggaagcaggtt

SEQ ID NO: 117076 - DNA, 25 bp, mus musculus
aaggatcgacgcaagccgtcagcca

SEQ ID NO: 117077 - DNA, 25 bp, mus musculus
gatcgacgcaagccgtcagccagac

SEQ ID NO: 117078 - DNA, 25 bp, mus musculus
cgacgcaagccgtcagccagacatc

SEQ ID NO: 117079 - DNA, 25 bp, mus musculus
cgcaagccgtcagccagacatccat

SEQ ID NO: 117080 - DNA, 25 bp, mus musculus
aagccgtcagccagacatccataaa

SEQ ID NO: 117081 - DNA, 25 bp, mus musculus
agcggattctctcgttcacgctcag

SEQ ID NO: 117082 - DNA, 25 bp, mus musculus
cgttcacgctcagcgccttgcggat

SEQ ID NO: 117083 - DNA, 25 bp, mus musculus
tcagcgccttgcggatgacatcgcg

SEQ ID NO: 117084 - DNA, 25 bp, mus musculus
gcgccttgcggatgacatcgcgcat

SEQ ID NO: 117085 - DNA, 25 bp, mus musculus
ggatgacatcgcgcatcatagtccc

SEQ ID NO: 117086 - DNA, 25 bp, mus musculus
tgacatcgcgcatcatagtcccagc

SEQ ID NO: 117087 - DNA, 25 bp, mus musculus
cagcccttgtcctagatccattcca

SEQ ID NO: 117088 - DNA, 25 bp, mus musculus
ttgtcctagatccattccactcgga

SEQ ID NO: 117089 - DNA, 25 bp, mus musculus
tctgagaatcagcactgctagtgga

SEQ ID NO: 117090 - DNA, 25 bp, mus musculus
gagaatcagcactgctagtggagat

SEQ ID NO: 117091 - DNA, 25 bp, mus musculus
ccgtgacatcatccagcgcatgcat

SEQ ID NO: 117092 - DNA, 25 bp, mus musculus
gcatctccgccaatacgagctgctc

SEQ ID NO: 117093 - DNA, 25 bp, mus musculus
tctccgccaatacgagctgctctaa

SEQ ID NO: 117094 - DNA, 25 bp, mus musculus
ccaatacgagctgctctaagaaggg

SEQ ID NO: 117095 - DNA, 25 bp, mus musculus
atacgagctgctctaagaagggaac

SEQ ID NO: 117096 - DNA, 25 bp, mus musculus
ttaattcagccttaagcacaattaa

SEQ ID NO: 117097 - DNA, 25 bp, mus musculus
gcatgatcaacaccgcaacctttcc

SEQ ID NO: 117098 - DNA, 25 bp, mus musculus
tgatcaacaccgcaacctttccttt

SEQ ID NO: 117099 - DNA, 25 bp, mus musculus
cacaccttgcttagatttccaaatt

SEQ ID NO: 117100 - DNA, 25 bp, mus musculus
gtaagcttaagggccctgcagaaga

SEQ ID NO: 117101 - DNA, 25 bp, mus musculus
aatcagcactgctagtggagatggg

SEQ ID NO: 117102 - DNA, 25 bp, mus musculus
tcactttacctgcgccgtggacact

SEQ ID NO: 117103 - DNA, 25 bp, mus musculus
ctttacctgcgccgtggacactgag

SEQ ID NO: 117104 - DNA, 25 bp, mus musculus
tgagaacatccgccgtgtcttcaac

SEQ ID NO: 117105 - DNA, 25 bp, mus musculus
catccgccgtgtcttcaacgactgc

SEQ ID NO: 117106 - DNA, 25 bp, mus musculus
ccgtgtcttcaacgactgccgtgac

SEQ ID NO: 117107 - DNA, 25 bp, mus musculus
tgtcttcaacgactgccgtgacatc

SEQ ID NO: 117108 - DNA, 25 bp, mus musculus
cttcaacgactgccgtgacatcatc

SEQ ID NO: 117109 - DNA, 25 bp, mus musculus
agagagccctgattgacatgtattc

SEQ ID NO: 117110 - DNA, 25 bp, mus musculus
gagccctgattgacatgtattcaga

SEQ ID NO: 117111 - DNA, 25 bp, mus musculus
attctcaactacatcgccaccaaat

SEQ ID NO: 117112 - DNA, 25 bp, mus musculus
ctcaactacatcgccaccaaatatg

SEQ ID NO: 117113 - DNA, 25 bp, mus musculus
tacatcgccaccaaatatgacctct

SEQ ID NO: 117114 - DNA, 25 bp, mus musculus
atcgccaccaaatatgacctctatg

SEQ ID NO: 117115 - DNA, 25 bp, mus musculus
gccaccaaatatgacctctatggga

SEQ ID NO: 117116 - DNA, 25 bp, mus musculus
accaaatatgacctctatgggaagg

SEQ ID NO: 117117 - DNA, 25 bp, mus musculus
aaatatgacctctatgggaaggaca

SEQ ID NO: 117118 - DNA, 25 bp, mus musculus
tatgacctctatgggaaggacatga

SEQ ID NO: 117119 - DNA, 25 bp, mus musculus
agagccctgattgacatgtattcag

SEQ ID NO: 117120 - DNA, 25 bp, mus musculus
gtattatgtcccccagaccaaagag

SEQ ID NO: 117121 - DNA, 25 bp, mus musculus
acatgtattcagagtccggaagatt

SEQ ID NO: 117122 - DNA, 25 bp, mus musculus
tgtattcagagtccggaagatttgg

SEQ ID NO: 117123 - DNA, 25 bp, mus musculus
gaccaagtgcccatggtggagattg

SEQ ID NO: 117124 - DNA, 25 bp, mus musculus
gcgcagaccagagccattctcaact

SEQ ID NO: 117125 - DNA, 25 bp, mus musculus
cagaccagagccattctcaactaca

SEQ ID NO: 117126 - DNA, 25 bp, mus musculus
accagagccattctcaactacatcg

SEQ ID NO: 117127 - DNA, 25 bp, mus musculus
agagccattctcaactacatcgcca

SEQ ID NO: 117128 - DNA, 25 bp, mus musculus
gccattctcaactacatcgccacca

SEQ ID NO: 117129 - DNA, 25 bp, mus musculus
acatgtattcagagtccggaagatt

SEQ ID NO: 117130 - DNA, 25 bp, mus musculus
catgtattcagagtccggaagattt

SEQ ID NO: 117131 - DNA, 25 bp, mus musculus
atgtattcagagtccggaagatttg

SEQ ID NO: 117132 - DNA, 25 bp, mus musculus
tgtattcagagtccggaagatttgg

SEQ ID NO: 117133 - DNA, 25 bp, mus musculus
gtattcagagtccggaagatttgga

SEQ ID NO: 117134 - DNA, 25 bp, mus musculus
tattcagagtccggaagatttggaa

SEQ ID NO: 117135 - DNA, 25 bp, mus musculus
tggtattatgtcccccagaccaaag

SEQ ID NO: 117136 - DNA, 25 bp, mus musculus
gtattatgtcccccagaccaaagag

SEQ ID NO: 117137 - DNA, 25 bp, mus musculus
acatgtattcagagtccggaagatt

SEQ ID NO: 117138 - DNA, 25 bp, mus musculus
catgtattcagagtccggaagattt

SEQ ID NO: 117139 - DNA, 25 bp, mus musculus
atgtattcagagtccggaagatttg

SEQ ID NO: 117140 - DNA, 25 bp, mus musculus
tgtattcagagtccggaagatttgg

SEQ ID NO: 117141 - DNA, 25 bp, mus musculus
gtattcagagtccggaagatttgga

SEQ ID NO: 117142 - DNA, 25 bp, mus musculus
tattcagagtccggaagatttggaa

SEQ ID NO: 117143 - DNA, 25 bp, mus musculus
tggtattatgtcccccagaccaaag

SEQ ID NO: 117144 - DNA, 25 bp, mus musculus
gtattatgtcccccagaccaaagag

SEQ ID NO: 117145 - DNA, 25 bp, mus musculus
cacttcacaacatctgagaaaaaca

SEQ ID NO: 117146 - DNA, 25 bp, mus musculus
agctacttgcttctaagattcgatg

SEQ ID NO: 117147 - DNA, 25 bp, mus musculus
caccctggcccatgaatcctggaat

SEQ ID NO: 117148 - DNA, 25 bp, mus musculus
cttatagccaatcttttctctcctt

SEQ ID NO: 117149 - DNA, 25 bp, mus musculus
cttttctctcctttcgtgctcagag

SEQ ID NO: 117150 - DNA, 25 bp, mus musculus
ttcgtgctcagagcatggaagtttt

SEQ ID NO: 117151 - DNA, 25 bp, mus musculus
tctgctgtctttggagctctgtctg

SEQ ID NO: 117152 - DNA, 25 bp, mus musculus
gtctttggagctctgtctgcaaaca

SEQ ID NO: 117153 - DNA, 25 bp, mus musculus
tctgcaaacagctcgaaggagatgc

SEQ ID NO: 117154 - DNA, 25 bp, mus musculus
gagatgcggcccaagggcttgtcat

SEQ ID NO: 117155 - DNA, 25 bp, mus musculus
cccaagggcttgtcattgggcatga

SEQ ID NO: 117156 - DNA, 25 bp, mus musculus
tcattgggcatgatgttggaagacc

SEQ ID NO: 117157 - DNA, 25 bp, mus musculus
tacttgcttctaagattcgatggac

SEQ ID NO: 117158 - DNA, 25 bp, mus musculus
ttgcttctaagattcgatggacctg

SEQ ID NO: 117159 - DNA, 25 bp, mus musculus
agattcgatggacctgccaccagtg

SEQ ID NO: 117160 - DNA, 25 bp, mus musculus
ttcgatggacctgccaccagtgcca

SEQ ID NO: 117161 - DNA, 25 bp, mus musculus
gatggacctgccaccagtgccatta

SEQ ID NO: 117162 - DNA, 25 bp, mus musculus
gccaccagtgccattatgtgcgtgt

SEQ ID NO: 117163 - DNA, 25 bp, mus musculus
accagtgccattatgtgcgtgtgaa

SEQ ID NO: 117164 - DNA, 25 bp, mus musculus
agtgccattatgtgcgtgtgaagtc

SEQ ID NO: 117165 - DNA, 25 bp, mus musculus
cacatgccccctgaggagaaagagg

SEQ ID NO: 117166 - DNA, 25 bp, mus musculus
gaggcaagccttgccaagatcaagg

SEQ ID NO: 117167 - DNA, 25 bp, mus musculus
ctctaccatgtggaagagctggacc

SEQ ID NO: 117168 - DNA, 25 bp, mus musculus
aagttccttcaacctggcagccaga

SEQ ID NO: 117169 - DNA, 25 bp, mus musculus
ttccttcaacctggcagccagagga

SEQ ID NO: 117170 - DNA, 25 bp, mus musculus
aagccttttgatgacgcaaaatgtg

SEQ ID NO: 117171 - DNA, 25 bp, mus musculus
aaattttgcatcacattgaagtgtt

SEQ ID NO: 117172 - DNA, 25 bp, mus musculus
ttttgcatcacattgaagtgttttg

SEQ ID NO: 117173 - DNA, 25 bp, mus musculus
cgtctgtgtcaattcaggtagacat

SEQ ID NO: 117174 - DNA, 25 bp, mus musculus
aacggccggatgctctctagttgta

SEQ ID NO: 117175 - DNA, 25 bp, mus musculus
cggatgctctctagttgtagttaaa

SEQ ID NO: 117176 - DNA, 25 bp, mus musculus
atgctctctagttgtagttaaaatt

SEQ ID NO: 117177 - DNA, 25 bp, mus musculus
gcaagccttgccaagatcaaggaac

SEQ ID NO: 117178 - DNA, 25 bp, mus musculus
caagattatctcgttggcaacaggc

SEQ ID NO: 117179 - DNA, 25 bp, mus musculus
gattatctcgttggcaacaggctga

SEQ ID NO: 117180 - DNA, 25 bp, mus musculus
tatctcgttggcaacaggctgagga

SEQ ID NO: 117181 - DNA, 25 bp, mus musculus
gctgatattgccctggttgaactcc

SEQ ID NO: 117182 - DNA, 25 bp, mus musculus
gatattgccctggttgaactcctct

SEQ ID NO: 117183 - DNA, 25 bp, mus musculus
ctggttgaactcctctaccatgtgg

SEQ ID NO: 117184 - DNA, 25 bp, mus musculus
gttgaactcctctaccatgtggaag

SEQ ID NO: 117185 - DNA, 25 bp, mus musculus
agacatactttcattgccacatttg

SEQ ID NO: 117186 - DNA, 25 bp, mus musculus
acatactttcattgccacatttgca

SEQ ID NO: 117187 - DNA, 25 bp, mus musculus
ctacgaagctcagactttgtgaaac

SEQ ID NO: 117188 - DNA, 25 bp, mus musculus
aacatcatgagaactcacacaggag

SEQ ID NO: 117189 - DNA, 25 bp, mus musculus
catcatgagaactcacacaggagag

SEQ ID NO: 117190 - DNA, 25 bp, mus musculus
tcatgagaactcacacaggagagaa

SEQ ID NO: 117191 - DNA, 25 bp, mus musculus
aggcttcagtgacttctcaggcttg

SEQ ID NO: 117192 - DNA, 25 bp, mus musculus
gcttcagtgacttctcaggcttgcg

SEQ ID NO: 117193 - DNA, 25 bp, mus musculus
ttgcgccaccacgagaaaatccaca

SEQ ID NO: 117194 - DNA, 25 bp, mus musculus
gcgccaccacgagaaaatccacaca

SEQ ID NO: 117195 - DNA, 25 bp, mus musculus
gccaccacgagaaaatccacacagg

SEQ ID NO: 117196 - DNA, 25 bp, mus musculus
caccacgagaaaatccacacaggag

SEQ ID NO: 117197 - DNA, 25 bp, mus musculus
atactttcattgccacatttgcaaa

SEQ ID NO: 117198 - DNA, 25 bp, mus musculus
actttcattgccacatttgcaaaaa

SEQ ID NO: 117199 - DNA, 25 bp, mus musculus
tttcattgccacatttgcaaaaaag

SEQ ID NO: 117200 - DNA, 25 bp, mus musculus
tcattgccacatttgcaaaaaagcc

SEQ ID NO: 117201 - DNA, 25 bp, mus musculus
attgccacatttgcaaaaaagcctt

SEQ ID NO: 117202 - DNA, 25 bp, mus musculus
aagcctttctacgaagctcagactt

SEQ ID NO: 117203 - DNA, 25 bp, mus musculus
gcctttctacgaagctcagactttg

SEQ ID NO: 117204 - DNA, 25 bp, mus musculus
ctttctacgaagctcagactttgtg

SEQ ID NO: 117205 - DNA, 25 bp, mus musculus
tggtcattccggccacgtttccaat

SEQ ID NO: 117206 - DNA, 25 bp, mus musculus
ccctgggtcagacttcagcatcggg

SEQ ID NO: 117207 - DNA, 25 bp, mus musculus
tgaccgaatcaagcagtctgcagca

SEQ ID NO: 117208 - DNA, 25 bp, mus musculus
aatcaagcagtctgcagcaggcacc

SEQ ID NO: 117209 - DNA, 25 bp, mus musculus
caagcagtctgcagcaggcaccaaa

SEQ ID NO: 117210 - DNA, 25 bp, mus musculus
gcagtctgcagcaggcaccaaacgt

SEQ ID NO: 117211 - DNA, 25 bp, mus musculus
caaacgtcgggtgtttatcatcgag

SEQ ID NO: 117212 - DNA, 25 bp, mus musculus
ctgtggctacctggccaccatggca

SEQ ID NO: 117213 - DNA, 25 bp, mus musculus
tggctacctggccaccatggcaggg

SEQ ID NO: 117214 - DNA, 25 bp, mus musculus
tgctgcctacatttttgaggaaccc

SEQ ID NO: 117215 - DNA, 25 bp, mus musculus
tgaggaacccttcaccattcgcgat

SEQ ID NO: 117216 - DNA, 25 bp, mus musculus
ggaacccttcaccattcgcgatctc

SEQ ID NO: 117217 - DNA, 25 bp, mus musculus
gtcagacttcagcatcggggctgac

SEQ ID NO: 117218 - DNA, 25 bp, mus musculus
cttcaccattcgcgatctccaggtg

SEQ ID NO: 117219 - DNA, 25 bp, mus musculus
agacttcagcatcggggctgacaca

SEQ ID NO: 117220 - DNA, 25 bp, mus musculus
cttcagcatcggggctgacacagca

SEQ ID NO: 117221 - DNA, 25 bp, mus musculus
ggctgacacagcactgaacaccatc

SEQ ID NO: 117222 - DNA, 25 bp, mus musculus
cacagcactgaacaccatctgcacg

SEQ ID NO: 117223 - DNA, 25 bp, mus musculus
actgaacaccatctgcacgacttgt

SEQ ID NO: 117224 - DNA, 25 bp, mus musculus
caccatctgcacgacttgtgaccga

SEQ ID NO: 117225 - DNA, 25 bp, mus musculus
catctgcacgacttgtgaccgaatc

SEQ ID NO: 117226 - DNA, 25 bp, mus musculus
ccagactcagctctagactactttc

SEQ ID NO: 117227 - DNA, 25 bp, mus musculus
gtggccctgaattcatcaggataaa

SEQ ID NO: 117228 - DNA, 25 bp, mus musculus
agagcgcatcagtctccatttgggg

SEQ ID NO: 117229 - DNA, 25 bp, mus musculus
gcgcatcagtctccatttggggccc

SEQ ID NO: 117230 - DNA, 25 bp, mus musculus
gccctaggttgttcccagggctgca

SEQ ID NO: 117231 - DNA, 25 bp, mus musculus
ctaggttgttcccagggctgcaaag

SEQ ID NO: 117232 - DNA, 25 bp, mus musculus
tgttcccagggctgcaaagcgtagg

SEQ ID NO: 117233 - DNA, 25 bp, mus musculus
tcccagggctgcaaagcgtaggtac

SEQ ID NO: 117234 - DNA, 25 bp, mus musculus
ggctgcctataaacactggttggga

SEQ ID NO: 117235 - DNA, 25 bp, mus musculus
acccaagggctgctgtattaaatgt

SEQ ID NO: 117236 - DNA, 25 bp, mus musculus
agattcgtccataaagtcactgttt

SEQ ID NO: 117237 - DNA, 25 bp, mus musculus
ttcgtccataaagtcactgtttgaa

SEQ ID NO: 117238 - DNA, 25 bp, mus musculus
ccacaaactggcacttccactgaac

SEQ ID NO: 117239 - DNA, 25 bp, mus musculus
aagtcactgtttgaaacctgcagcc

SEQ ID NO: 117240 - DNA, 25 bp, mus musculus
actggcacttccactgaactcttgc

SEQ ID NO: 117241 - DNA, 25 bp, mus musculus
ggcacttccactgaactcttgccac

SEQ ID NO: 117242 - DNA, 25 bp, mus musculus
acttccactgaactcttgccacaca

SEQ ID NO: 117243 - DNA, 25 bp, mus musculus
ctcttgccacacaggctctgggtga

SEQ ID NO: 117244 - DNA, 25 bp, mus musculus
acacaatagtacatacctgacaggg

SEQ ID NO: 117245 - DNA, 25 bp, mus musculus
caatagtacatacctgacagggcaa

SEQ ID NO: 117246 - DNA, 25 bp, mus musculus
tacatacctgacagggcaaggacgg

SEQ ID NO: 117247 - DNA, 25 bp, mus musculus
acatgcagaagcgctgctggggagc

SEQ ID NO: 117248 - DNA, 25 bp, mus musculus
ggcagcacgacccgtctcgccatgg

SEQ ID NO: 117249 - DNA, 25 bp, mus musculus
tcaagacattcggcatgagtccggc

SEQ ID NO: 117250 - DNA, 25 bp, mus musculus
caagacattcggcatgagtccggcg

SEQ ID NO: 117251 - DNA, 25 bp, mus musculus
aagacattcggcatgagtccggcgg

SEQ ID NO: 117252 - DNA, 25 bp, mus musculus
agacattcggcatgagtccggcggg

SEQ ID NO: 117253 - DNA, 25 bp, mus musculus
acattcggcatgagtccggcgggtt

SEQ ID NO: 117254 - DNA, 25 bp, mus musculus
cattcggcatgagtccggcgggttt

SEQ ID NO: 117255 - DNA, 25 bp, mus musculus
gcatgagtccggcgggtttcctttg

SEQ ID NO: 117256 - DNA, 25 bp, mus musculus
gcagcacgacccgtctcgccatgga

SEQ ID NO: 117257 - DNA, 25 bp, mus musculus
gtatttatcaagacattcggcatga

SEQ ID NO: 117258 - DNA, 25 bp, mus musculus
tatttatcaagacattcggcatgag

SEQ ID NO: 117259 - DNA, 25 bp, mus musculus
atttatcaagacattcggcatgagt

SEQ ID NO: 117260 - DNA, 25 bp, mus musculus
tttatcaagacattcggcatgagtc

SEQ ID NO: 117261 - DNA, 25 bp, mus musculus
ttatcaagacattcggcatgagtcc

SEQ ID NO: 117262 - DNA, 25 bp, mus musculus
tatcaagacattcggcatgagtccg

SEQ ID NO: 117263 - DNA, 25 bp, mus musculus
atcaagacattcggcatgagtccgg

SEQ ID NO: 117264 - DNA, 25 bp, mus musculus
ggcttttctcgttggcaaccagctc

SEQ ID NO: 117265 - DNA, 25 bp, mus musculus
tctcgttggcaaccagctcagttgg

SEQ ID NO: 117266 - DNA, 25 bp, mus musculus
cctgcaacccggaagtcagaggaag

SEQ ID NO: 117267 - DNA, 25 bp, mus musculus
tccagatggcccctatgttgaggtg

SEQ ID NO: 117268 - DNA, 25 bp, mus musculus
gattgtcctgaagttctagtgcagc

SEQ ID NO: 117269 - DNA, 25 bp, mus musculus
tggcacccacaaggttccaattgca

SEQ ID NO: 117270 - DNA, 25 bp, mus musculus
aattgcagtgtcaccacaggccagc

SEQ ID NO: 117271 - DNA, 25 bp, mus musculus
agtgtcaccacaggccagctgcaga

SEQ ID NO: 117272 - DNA, 25 bp, mus musculus
accacaggccagctgcagagcattc

SEQ ID NO: 117273 - DNA, 25 bp, mus musculus
agcattccagaagcaaggtatatag

SEQ ID NO: 117274 - DNA, 25 bp, mus musculus
gatcccaggagtcaagctcttcaaa

SEQ ID NO: 117275 - DNA, 25 bp, mus musculus
ctctgcccacaatgacaaatgccaa

SEQ ID NO: 117276 - DNA, 25 bp, mus musculus
tggcaaccagctcagttgggcagac

SEQ ID NO: 117277 - DNA, 25 bp, mus musculus
catccagctcctagaagccattttg

SEQ ID NO: 117278 - DNA, 25 bp, mus musculus
gctcctagaagccattttgatggtg

SEQ ID NO: 117279 - DNA, 25 bp, mus musculus
ggaagaactcagtgcccctgtactg

SEQ ID NO: 117280 - DNA, 25 bp, mus musculus
cttccctctgctgcaggcatttaag

SEQ ID NO: 117281 - DNA, 25 bp, mus musculus
tctgctgcaggcatttaagacaaga

SEQ ID NO: 117282 - DNA, 25 bp, mus musculus
aatcagcaacattcctacaattaag

SEQ ID NO: 117283 - DNA, 25 bp, mus musculus
gaagttcctgcaacccggaagtcag

SEQ ID NO: 117284 - DNA, 25 bp, mus musculus
agtggcttcctcagttggccaggca

SEQ ID NO: 117285 - DNA, 25 bp, mus musculus
ggcttcctcagttggccaggcaact

SEQ ID NO: 117286 - DNA, 25 bp, mus musculus
ttagcagcctggccttggaatggct

SEQ ID NO: 117287 - DNA, 25 bp, mus musculus
gcctggccttggaatggctagatca

SEQ ID NO: 117288 - DNA, 25 bp, mus musculus
atcaggttcatgcactgattcatcc

SEQ ID NO: 117289 - DNA, 25 bp, mus musculus
aggttcatgcactgattcatccagc

SEQ ID NO: 117290 - DNA, 25 bp, mus musculus
atgcactgattcatccagctaagat

SEQ ID NO: 117291 - DNA, 25 bp, mus musculus
cactgattcatccagctaagatctg

SEQ ID NO: 117292 - DNA, 25 bp, mus musculus
tgattcatccagctaagatctgtgg

SEQ ID NO: 117293 - DNA, 25 bp, mus musculus
atccagctaagatctgtggaaatcc

SEQ ID NO: 117294 - DNA, 25 bp, mus musculus
agagatgacctccatcttgcgaagt

SEQ ID NO: 117295 - DNA, 25 bp, mus musculus
catcttgcgaagtccccaagctctt

SEQ ID NO: 117296 - DNA, 25 bp, mus musculus
ctcagttggccaggcaacttgtaaa

SEQ ID NO: 117297 - DNA, 25 bp, mus musculus
aagtcaagccagtttctttgcttgg

SEQ ID NO: 117298 - DNA, 25 bp, mus musculus
tcaagccagtttctttgcttggcag

SEQ ID NO: 117299 - DNA, 25 bp, mus musculus
cagtttctttgcttggcagcacttt

SEQ ID NO: 117300 - DNA, 25 bp, mus musculus
ttggcagcactttcttgtaaaccaa

SEQ ID NO: 117301 - DNA, 25 bp, mus musculus
gcagcactttcttgtaaaccaataa

SEQ ID NO: 117302 - DNA, 25 bp, mus musculus
tcttgtaaaccaataactaagacag

SEQ ID NO: 117303 - DNA, 25 bp, mus musculus
tacagatcgccggtcctcccaggag

SEQ ID NO: 117304 - DNA, 25 bp, mus musculus
ggcacgaacttccgccgactgcgtc

SEQ ID NO: 117305 - DNA, 25 bp, mus musculus
cagtccgggcacgcgtaaggcttct

SEQ ID NO: 117306 - DNA, 25 bp, mus musculus
ctgcgcaaagcgcgcccacagtgtg

SEQ ID NO: 117307 - DNA, 25 bp, mus musculus
gcgcaaagcgcgcccacagtgtgcg

SEQ ID NO: 117308 - DNA, 25 bp, mus musculus
caaagcgcgcccacagtgtgcgcat

SEQ ID NO: 117309 - DNA, 25 bp, mus musculus
aaagcgcgcccacagtgtgcgcatc

SEQ ID NO: 117310 - DNA, 25 bp, mus musculus
cgcccacagtgtgcgcatcgtacgg

SEQ ID NO: 117311 - DNA, 25 bp, mus musculus
cccacagtgtgcgcatcgtacggct

SEQ ID NO: 117312 - DNA, 25 bp, mus musculus
ccacagtgtgcgcatcgtacggctt

SEQ ID NO: 117313 - DNA, 25 bp, mus musculus
gcatcgtacggcttctctccggtgt

SEQ ID NO: 117314 - DNA, 25 bp, mus musculus
catcgtacggcttctctccggtgtg

SEQ ID NO: 117315 - DNA, 25 bp, mus musculus
tcgtacggcttctctccggtgtgac

SEQ ID NO: 117316 - DNA, 25 bp, mus musculus
tccgggcacgcgtaaggcttctcgc

SEQ ID NO: 117317 - DNA, 25 bp, mus musculus
cacgcgtaaggcttctcgcccgtgt

SEQ ID NO: 117318 - DNA, 25 bp, mus musculus
acgcgtaaggcttctcgcccgtgtg

SEQ ID NO: 117319 - DNA, 25 bp, mus musculus
cgtaaggcttctcgcccgtgtgcac

SEQ ID NO: 117320 - DNA, 25 bp, mus musculus
taaggcttctcgcccgtgtgcacgc

SEQ ID NO: 117321 - DNA, 25 bp, mus musculus
attggagctctgcgcaaagcgcgcc

SEQ ID NO: 117322 - DNA, 25 bp, mus musculus
agctctgcgcaaagcgcgcccacag

SEQ ID NO: 117323 - DNA, 25 bp, mus musculus
tctgcgcaaagcgcgcccacagtgt

SEQ ID NO: 117324 - DNA, 25 bp, mus musculus
agccggctaccagcgccccaagaag

SEQ ID NO: 117325 - DNA, 25 bp, mus musculus
caagaagacacggcttctgaggcag

SEQ ID NO: 117326 - DNA, 25 bp, mus musculus
gatgccagtctatagcgggtaccag

SEQ ID NO: 117327 - DNA, 25 bp, mus musculus
tctccccatgcatcctagccagtga

SEQ ID NO: 117328 - DNA, 25 bp, mus musculus
tcctagccagtgagtgctacatcct

SEQ ID NO: 117329 - DNA, 25 bp, mus musculus
agtgctacatcctttgcaagtggag

SEQ ID NO: 117330 - DNA, 25 bp, mus musculus
acatcctttgcaagtggagttactg

SEQ ID NO: 117331 - DNA, 25 bp, mus musculus
gcattcttcctgtctgcactgcctg

SEQ ID NO: 117332 - DNA, 25 bp, mus musculus
ttcctgtctgcactgcctgggccaa

SEQ ID NO: 117333 - DNA, 25 bp, mus musculus
tctgcactgcctgggccaaggggca

SEQ ID NO: 117334 - DNA, 25 bp, mus musculus
ctgcctgggccaaggggcagaaaca

SEQ ID NO: 117335 - DNA, 25 bp, mus musculus
actctgctcttcttccccaggacat

SEQ ID NO: 117336 - DNA, 25 bp, mus musculus
gtccaaactcgagatgatggtgatg

SEQ ID NO: 117337 - DNA, 25 bp, mus musculus
ggactgctaacacatagcgaggagg

SEQ ID NO: 117338 - DNA, 25 bp, mus musculus
gagcacagccaggacacagatgcag

SEQ ID NO: 117339 - DNA, 25 bp, mus musculus
agccaggacacagatgcagaagatg

SEQ ID NO: 117340 - DNA, 25 bp, mus musculus
cattggccaccagcagaagggcatc

SEQ ID NO: 117341 - DNA, 25 bp, mus musculus
gggcatcactgtctcaggcctcaag

SEQ ID NO: 117342 - DNA, 25 bp, mus musculus
gccaggcacccatctctggatgcca

SEQ ID NO: 117343 - DNA, 25 bp, mus musculus
cacccatctctggatgccagtctat

SEQ ID NO: 117344 - DNA, 25 bp, mus musculus
caagctacgagtgctgctgaagctt

SEQ ID NO: 117345 - DNA, 25 bp, mus musculus
acgagtgctgctgaagctttttgtg

SEQ ID NO: 117346 - DNA, 25 bp, mus musculus
gctaaacatctcttgagaaagatag

SEQ ID NO: 117347 - DNA, 25 bp, mus musculus
gttgcctagctaaacagtgaatgga

SEQ ID NO: 117348 - DNA, 25 bp, mus musculus
atttcaaattgtgtgtccaaattgg

SEQ ID NO: 117349 - DNA, 25 bp, mus musculus
tcttccctaagctccacagaagtgt

SEQ ID NO: 117350 - DNA, 25 bp, mus musculus
ctaagctccacagaagtgtatccca

SEQ ID NO: 117351 - DNA, 25 bp, mus musculus
tccacagaagtgtatcccatgaagg

SEQ ID NO: 117352 - DNA, 25 bp, mus musculus
cattgcttccctctagagattacta

SEQ ID NO: 117353 - DNA, 25 bp, mus musculus
ttccctctagagattactaccatgc

SEQ ID NO: 117354 - DNA, 25 bp, mus musculus
ccacctgcctctgtgttaagagata

SEQ ID NO: 117355 - DNA, 25 bp, mus musculus
tttctgatccatttgtaccaataaa

SEQ ID NO: 117356 - DNA, 25 bp, mus musculus
gaagctttttgtgctgtgaaaggag

SEQ ID NO: 117357 - DNA, 25 bp, mus musculus
ggccctgaatcttctgccttccagg

SEQ ID NO: 117358 - DNA, 25 bp, mus musculus
tctgccttccaggctttaaaagtct

SEQ ID NO: 117359 - DNA, 25 bp, mus musculus
tattataggcgcacacagttcctta

SEQ ID NO: 117360 - DNA, 25 bp, mus musculus
aggcgcacacagttccttaacatag

SEQ ID NO: 117361 - DNA, 25 bp, mus musculus
acacagttccttaacatagtggttg

SEQ ID NO: 117362 - DNA, 25 bp, mus musculus
ttccttaacatagtggttgacgatg

SEQ ID NO: 117363 - DNA, 25 bp, mus musculus
gacgatgctaaacatctcttgagaa

SEQ ID NO: 117364 - DNA, 25 bp, mus musculus
tgagcgtccttcactcggcctcggc

SEQ ID NO: 117365 - DNA, 25 bp, mus musculus
gagcgtccttcactcggcctcggcg

SEQ ID NO: 117366 - DNA, 25 bp, mus musculus
cgcctctgaggcaaacctggtggac

SEQ ID NO: 117367 - DNA, 25 bp, mus musculus
gcctctgaggcaaacctggtggacc

SEQ ID NO: 117368 - DNA, 25 bp, mus musculus
gcaaacctggtggacctccagaaga

SEQ ID NO: 117369 - DNA, 25 bp, mus musculus
acctggtggacctccagaagaagct

SEQ ID NO: 117370 - DNA, 25 bp, mus musculus
ctggtggacctccagaagaagctgg

SEQ ID NO: 117371 - DNA, 25 bp, mus musculus
tggtggacctccagaagaagctgga

SEQ ID NO: 117372 - DNA, 25 bp, mus musculus
ggacctccagaagaagctggaagag

SEQ ID NO: 117373 - DNA, 25 bp, mus musculus
gacctccagaagaagctggaagagc

SEQ ID NO: 117374 - DNA, 25 bp, mus musculus
acctccagaagaagctggaagagct

SEQ ID NO: 117375 - DNA, 25 bp, mus musculus
agcgtccttcactcggcctcggcgt

SEQ ID NO: 117376 - DNA, 25 bp, mus musculus
agccccgatgctggcccggagaagc

SEQ ID NO: 117377 - DNA, 25 bp, mus musculus
tgttaccggactcactatcaaccct

SEQ ID NO: 117378 - DNA, 25 bp, mus musculus
ggactcactatcaaccctaccatcg

SEQ ID NO: 117379 - DNA, 25 bp, mus musculus
ccaccagcgagggcgcctctgaggc

SEQ ID NO: 117380 - DNA, 25 bp, mus musculus
caccagcgagggcgcctctgaggca

SEQ ID NO: 117381 - DNA, 25 bp, mus musculus
ggcgcctctgaggcaaacctggtgg

SEQ ID NO: 117382 - DNA, 25 bp, mus musculus
gcgcctctgaggcaaacctggtgga

SEQ ID NO: 117383 - DNA, 25 bp, mus musculus
cacctaccaggcaaccatcgggatt

SEQ ID NO: 117384 - DNA, 25 bp, mus musculus
ccaggcaaccatcgggattgacttc

SEQ ID NO: 117385 - DNA, 25 bp, mus musculus
catccgagactccacggtggctgtg

SEQ ID NO: 117386 - DNA, 25 bp, mus musculus
atatgacattactaatctcaactcc

SEQ ID NO: 117387 - DNA, 25 bp, mus musculus
tgacattactaatctcaactccttc

SEQ ID NO: 117388 - DNA, 25 bp, mus musculus
cattactaatctcaactccttccag

SEQ ID NO: 117389 - DNA, 25 bp, mus musculus
taatctcaactccttccagcagact

SEQ ID NO: 117390 - DNA, 25 bp, mus musculus
caactccttccagcagacttctaaa

SEQ ID NO: 117391 - DNA, 25 bp, mus musculus
ccagcagacttctaaatggattgat

SEQ ID NO: 117392 - DNA, 25 bp, mus musculus
tgacgtgatcatcatgcttgtgggt

SEQ ID NO: 117393 - DNA, 25 bp, mus musculus
cgtgatcatcatgcttgtgggtaac

SEQ ID NO: 117394 - DNA, 25 bp, mus musculus
catcatgcttgtgggtaacaagacg

SEQ ID NO: 117395 - DNA, 25 bp, mus musculus
tgacttcttgtcaaaaaccatgtac

SEQ ID NO: 117396 - DNA, 25 bp, mus musculus
cttcttgtcaaaaaccatgtacttg

SEQ ID NO: 117397 - DNA, 25 bp, mus musculus
agaccgtacggttcgactgcagctc

SEQ ID NO: 117398 - DNA, 25 bp, mus musculus
tacggttcgactgcagctctgggac

SEQ ID NO: 117399 - DNA, 25 bp, mus musculus
ggttcgactgcagctctgggacact

SEQ ID NO: 117400 - DNA, 25 bp, mus musculus
tcgactgcagctctgggacactgct

SEQ ID NO: 117401 - DNA, 25 bp, mus musculus
cagctacatccgagactccacggtg

SEQ ID NO: 117402 - DNA, 25 bp, mus musculus
ctacatccgagactccacggtggct

SEQ ID NO: 117403 - DNA, 25 bp, mus musculus
gttgatcacctttatttgacgtatc

SEQ ID NO: 117404 - DNA, 25 bp, mus musculus
gatcacctttatttgacgtatctat

SEQ ID NO: 117405 - DNA, 25 bp, mus musculus
tcccggaacacgcccagcatggtgc

SEQ ID NO: 117406 - DNA, 25 bp, mus musculus
aacacgcccagcatggtgctagtga

SEQ ID NO: 117407 - DNA, 25 bp, mus musculus
cccagcatggtgctagtgacagtct

SEQ ID NO: 117408 - DNA, 25 bp, mus musculus
ctagtgacagtcttgctgttcattt

SEQ ID NO: 117409 - DNA, 25 bp, mus musculus
gtgacagtcttgctgttcattttct

SEQ ID NO: 117410 - DNA, 25 bp, mus musculus
ctgttcattttctgcacgcctcgca

SEQ ID NO: 117411 - DNA, 25 bp, mus musculus
ttcattttctgcacgcctcgcatta

SEQ ID NO: 117412 - DNA, 25 bp, mus musculus
tgcacgcctcgcattaccatgcaca

SEQ ID NO: 117413 - DNA, 25 bp, mus musculus
acgcctcgcattaccatgcacatgt

SEQ ID NO: 117414 - DNA, 25 bp, mus musculus
cctcgcattaccatgcacatgtgtg

SEQ ID NO: 117415 - DNA, 25 bp, mus musculus
gtgtaccaactgaaactggaatgta

SEQ ID NO: 117416 - DNA, 25 bp, mus musculus
acagataacagccgcagcagcgggg

SEQ ID NO: 117417 - DNA, 25 bp, mus musculus
gataacagccgcagcagcggggtct

SEQ ID NO: 117418 - DNA, 25 bp, mus musculus
cgcagcagcggggtctgcaaaccag

SEQ ID NO: 117419 - DNA, 25 bp, mus musculus
ggaagctcagctcagctcctgatta

SEQ ID NO: 117420 - DNA, 25 bp, mus musculus
agctcagctcagctcctgattagtg

SEQ ID NO: 117421 - DNA, 25 bp, mus musculus
cagctcctgattagtgtgaggaact

SEQ ID NO: 117422 - DNA, 25 bp, mus musculus
ctcctgattagtgtgaggaactcct

SEQ ID NO: 117423 - DNA, 25 bp, mus musculus
ttcgatattcgggactgagaaggac

SEQ ID NO: 117424 - DNA, 25 bp, mus musculus
atattcgggactgagaaggacaagt

SEQ ID NO: 117425 - DNA, 25 bp, mus musculus
ttaagattggggcctgccggcacgg

SEQ ID NO: 117426 - DNA, 25 bp, mus musculus
ttcacaacaaaccgactttcagcca

SEQ ID NO: 117427 - DNA, 25 bp, mus musculus
cacaacaaaccgactttcagccaga

SEQ ID NO: 117428 - DNA, 25 bp, mus musculus
accgactttcagccagaccatacgt

SEQ ID NO: 117429 - DNA, 25 bp, mus musculus
cgactttcagccagaccatacgtcc

SEQ ID NO: 117430 - DNA, 25 bp, mus musculus
tcagccagaccatacgtcctgctca

SEQ ID NO: 117431 - DNA, 25 bp, mus musculus
ccagaccatacgtcctgctcaactt

SEQ ID NO: 117432 - DNA, 25 bp, mus musculus
agaccatacgtcctgctcaacttgt

SEQ ID NO: 117433 - DNA, 25 bp, mus musculus
catacgtcctgctcaacttgtaccg

SEQ ID NO: 117434 - DNA, 25 bp, mus musculus
tacgtcctgctcaacttgtaccgga

SEQ ID NO: 117435 - DNA, 25 bp, mus musculus
gcctctcagggagccggggcacttg

SEQ ID NO: 117436 - DNA, 25 bp, mus musculus
cagtgttcgtgggatgcccggcctt

SEQ ID NO: 117437 - DNA, 25 bp, mus musculus
tttacctctgtctttgcacctcttc

SEQ ID NO: 117438 - DNA, 25 bp, mus musculus
tacctctgtctttgcacctcttcca

SEQ ID NO: 117439 - DNA, 25 bp, mus musculus
tgtctttgcacctcttccagtctta

SEQ ID NO: 117440 - DNA, 25 bp, mus musculus
tctttgcacctcttccagtcttaac

SEQ ID NO: 117441 - DNA, 25 bp, mus musculus
tgcacctcttccagtcttaactgct

SEQ ID NO: 117442 - DNA, 25 bp, mus musculus
cctcttccagtcttaactgctcttt

SEQ ID NO: 117443 - DNA, 25 bp, mus musculus
gctaagcccaaagcaaaaagggcag

SEQ ID NO: 117444 - DNA, 25 bp, mus musculus
aagcccaagaaggctgcggggacag

SEQ ID NO: 117445 - DNA, 25 bp, mus musculus
gctgcagctgcaggagccaaaaaag

SEQ ID NO: 117446 - DNA, 25 bp, mus musculus
ctgcagctgcaggagccaaaaaagc

SEQ ID NO: 117447 - DNA, 25 bp, mus musculus
gctaagaaggcgcccaagagccctg

SEQ ID NO: 117448 - DNA, 25 bp, mus musculus
agaaggcgcccaagagccctgccaa

SEQ ID NO: 117449 - DNA, 25 bp, mus musculus
aaggcgcccaagagccctgccaagg

SEQ ID NO: 117450 - DNA, 25 bp, mus musculus
gcgcccaagagccctgccaaggcga

SEQ ID NO: 117451 - DNA, 25 bp, mus musculus
cgcccaagagccctgccaaggcgaa

SEQ ID NO: 117452 - DNA, 25 bp, mus musculus
acctccaagcctaaggcagctaagc

SEQ ID NO: 117453 - DNA, 25 bp, mus musculus
cctccaagcctaaggcagctaagcc

SEQ ID NO: 117454 - DNA, 25 bp, mus musculus
tccaagcctaaggcagctaagccaa

SEQ ID NO: 117455 - DNA, 25 bp, mus musculus
agcccaagaaggctgcggggacagc

SEQ ID NO: 117456 - DNA, 25 bp, mus musculus
cccaagaaggctgcggggacagcca

SEQ ID NO: 117457 - DNA, 25 bp, mus musculus
accgccaagaagagcaccaagaaga

SEQ ID NO: 117458 - DNA, 25 bp, mus musculus
gcaccaagaagactccaaagaaagc

SEQ ID NO: 117459 - DNA, 25 bp, mus musculus
aagccagctgcagctgcaggagcca

SEQ ID NO: 117460 - DNA, 25 bp, mus musculus
agccagctgcagctgcaggagccaa

SEQ ID NO: 117461 - DNA, 25 bp, mus musculus
ccagctgcagctgcaggagccaaaa

SEQ ID NO: 117462 - DNA, 25 bp, mus musculus
cagctgcagctgcaggagccaaaaa

SEQ ID NO: 117463 - DNA, 25 bp, mus musculus
aatcagaaagactgcccatatatgt

SEQ ID NO: 117464 - DNA, 25 bp, mus musculus
atcagaaagactgcccatatatgtg

SEQ ID NO: 117465 - DNA, 25 bp, mus musculus
caaactttcacaggcagctgttctg

SEQ ID NO: 117466 - DNA, 25 bp, mus musculus
aactttcacaggcagctgttctgtt

SEQ ID NO: 117467 - DNA, 25 bp, mus musculus
actttcacaggcagctgttctgttg

SEQ ID NO: 117468 - DNA, 25 bp, mus musculus
tttcacaggcagctgttctgttggc

SEQ ID NO: 117469 - DNA, 25 bp, mus musculus
acaggcagctgttctgttggctcga

SEQ ID NO: 117470 - DNA, 25 bp, mus musculus
ggcagctgttctgttggctcgataa

SEQ ID NO: 117471 - DNA, 25 bp, mus musculus
cagctgttctgttggctcgataaat

SEQ ID NO: 117472 - DNA, 25 bp, mus musculus
agctgttctgttggctcgataaatg

SEQ ID NO: 117473 - DNA, 25 bp, mus musculus
ctgttctgttggctcgataaatggg

SEQ ID NO: 117474 - DNA, 25 bp, mus musculus
tgttctgttggctcgataaatgggt

SEQ ID NO: 117475 - DNA, 25 bp, mus musculus
cagaaagactgcccatatatgtgtg

SEQ ID NO: 117476 - DNA, 25 bp, mus musculus
aagactgcccatatatgtgtgcata

SEQ ID NO: 117477 - DNA, 25 bp, mus musculus
actgcccatatatgtgtgcatacaa

SEQ ID NO: 117478 - DNA, 25 bp, mus musculus
tgcccatatatgtgtgcatacaaac

SEQ ID NO: 117479 - DNA, 25 bp, mus musculus
catacaaactggttactgtcaagtt

SEQ ID NO: 117480 - DNA, 25 bp, mus musculus
ctgtttacaaactttcacaggcagc

SEQ ID NO: 117481 - DNA, 25 bp, mus musculus
tgtttacaaactttcacaggcagct

SEQ ID NO: 117482 - DNA, 25 bp, mus musculus
ttacaaactttcacaggcagctgtt

SEQ ID NO: 117483 - DNA, 25 bp, mus musculus
accttcggtgtcggagctcatcgtg

SEQ ID NO: 117484 - DNA, 25 bp, mus musculus
ggagctcatcgtgcaggcagtttct

SEQ ID NO: 117485 - DNA, 25 bp, mus musculus
taagaagactgctggggctgcagct

SEQ ID NO: 117486 - DNA, 25 bp, mus musculus
gactgtcaagactccgaagaagccc

SEQ ID NO: 117487 - DNA, 25 bp, mus musculus
gaagcccaagaagcctgcagtttcc

SEQ ID NO: 117488 - DNA, 25 bp, mus musculus
caagaagcctgcagtttccaagaag

SEQ ID NO: 117489 - DNA, 25 bp, mus musculus
gacttccaagagccccaagaagccg

SEQ ID NO: 117490 - DNA, 25 bp, mus musculus
agccaaaagccctgccaaggcgaag

SEQ ID NO: 117491 - DNA, 25 bp, mus musculus
taaggcttccaaggcgaaagtgaca

SEQ ID NO: 117492 - DNA, 25 bp, mus musculus
gacaaagccaaagaccccagctaag

SEQ ID NO: 117493 - DNA, 25 bp, mus musculus
gccaaagaccccagctaagcccaag

SEQ ID NO: 117494 - DNA, 25 bp, mus musculus
gaccccagctaagcccaagaaggca

SEQ ID NO: 117495 - DNA, 25 bp, mus musculus
catcgtgcaggcagtttcttcttcc

SEQ ID NO: 117496 - DNA, 25 bp, mus musculus
agtttcttcttccaaagagcgcagt

SEQ ID NO: 117497 - DNA, 25 bp, mus musculus
taaaggcacactggtgcagaccaag

SEQ ID NO: 117498 - DNA, 25 bp, mus musculus
tgctggctcttttaagctgaacaag

SEQ ID NO: 117499 - DNA, 25 bp, mus musculus
ctcttttaagctgaacaagaaggct

SEQ ID NO: 117500 - DNA, 25 bp, mus musculus
caaggccatcaccaccaaggtgtca

SEQ ID NO: 117501 - DNA, 25 bp, mus musculus
caccaaggtgtcagtgaaggcgaaa

SEQ ID NO: 117502 - DNA, 25 bp, mus musculus
agcatccggggctgctaagaaacct

SEQ ID NO: 117503 - DNA, 25 bp, mus musculus
gcacaatggctatgaccctagggcg

SEQ ID NO: 117504 - DNA, 25 bp, mus musculus
caatggctatgaccctagggcgatg

SEQ ID NO: 117505 - DNA, 25 bp, mus musculus
tactcacgggcagtttgatgagcgc

SEQ ID NO: 117506 - DNA, 25 bp, mus musculus
tgagcgctatgtgttgtcctctcgg

SEQ ID NO: 117507 - DNA, 25 bp, mus musculus
ctctcgggtacgcactggccgaagc

SEQ ID NO: 117508 - DNA, 25 bp, mus musculus
cgatctggctggccgctactacaag

SEQ ID NO: 117509 - DNA, 25 bp, mus musculus
tggccgctactacaagctgtctgag

SEQ ID NO: 117510 - DNA, 25 bp, mus musculus
ccgctactacaagctgtctgagatg

SEQ ID NO: 117511 - DNA, 25 bp, mus musculus
ctacaagctgtctgagatgacggag

SEQ ID NO: 117512 - DNA, 25 bp, mus musculus
caagctgtctgagatgacggagcag

SEQ ID NO: 117513 - DNA, 25 bp, mus musculus
ggatcagcaacgtctcatcgatgac

SEQ ID NO: 117514 - DNA, 25 bp, mus musculus
tcagcaacgtctcatcgatgaccac

SEQ ID NO: 117515 - DNA, 25 bp, mus musculus
tggctatgaccctagggcgatgaag

SEQ ID NO: 117516 - DNA, 25 bp, mus musculus
acgtctcatcgatgaccactttctg

SEQ ID NO: 117517 - DNA, 25 bp, mus musculus
tgaccctagggcgatgaagcatcct

SEQ ID NO: 117518 - DNA, 25 bp, mus musculus
gaagcatcctacggacctggatgca

SEQ ID NO: 117519 - DNA, 25 bp, mus musculus
gcatcctacggacctggatgcatcc

SEQ ID NO: 117520 - DNA, 25 bp, mus musculus
tacggacctggatgcatccaagatt

SEQ ID NO: 117521 - DNA, 25 bp, mus musculus
cctggatgcatccaagattactcac

SEQ ID NO: 117522 - DNA, 25 bp, mus musculus
tgcatccaagattactcacgggcag

SEQ ID NO: 117523 - DNA, 25 bp, mus musculus
atccaagattactcacgggcagttt

SEQ ID NO: 117524 - DNA, 25 bp, mus musculus
cagccccggcgtctttgcttcagct

SEQ ID NO: 117525 - DNA, 25 bp, mus musculus
cggcgtctttgcttcagcttggtgc

SEQ ID NO: 117526 - DNA, 25 bp, mus musculus
ttaccggcctgtggacaagagttct

SEQ ID NO: 117527 - DNA, 25 bp, mus musculus
tatacctgccgcaggcgactggcag

SEQ ID NO: 117528 - DNA, 25 bp, mus musculus
tacaacccaaacacctagataccag

SEQ ID NO: 117529 - DNA, 25 bp, mus musculus
ccaaacacctagataccagcacaag

SEQ ID NO: 117530 - DNA, 25 bp, mus musculus
acctagataccagcacaagccggtg

SEQ ID NO: 117531 - DNA, 25 bp, mus musculus
ataccagcacaagccggtgaatccc

SEQ ID NO: 117532 - DNA, 25 bp, mus musculus
gccggtgaatccctgtctggactga

SEQ ID NO: 117533 - DNA, 25 bp, mus musculus
gaatccctgtctggactgagcctct

SEQ ID NO: 117534 - DNA, 25 bp, mus musculus
ctgtctggactgagcctctggcttc

SEQ ID NO: 117535 - DNA, 25 bp, mus musculus
ttttgcagctattacaagtttacaa

SEQ ID NO: 117536 - DNA, 25 bp, mus musculus
acttgattgccgggctttgaggagg

SEQ ID NO: 117537 - DNA, 25 bp, mus musculus
ttgccgggctttgaggaggagaaat

SEQ ID NO: 117538 - DNA, 25 bp, mus musculus
tggatcacattgtttcttcggtgtc

SEQ ID NO: 117539 - DNA, 25 bp, mus musculus
tttcttcggtgtcaccgttgctggc

SEQ ID NO: 117540 - DNA, 25 bp, mus musculus
tgctggcctcataccagttgaccct

SEQ ID NO: 117541 - DNA, 25 bp, mus musculus
accagttgaccctgtcgccattcgt

SEQ ID NO: 117542 - DNA, 25 bp, mus musculus
taatgtgaacccagtttctccagga

SEQ ID NO: 117543 - DNA, 25 bp, mus musculus
agactcttaccggcctgtggacaag

SEQ ID NO: 117544 - DNA, 25 bp, mus musculus
ttaccaatctgaaaggcaccattga

SEQ ID NO: 117545 - DNA, 25 bp, mus musculus
accaatctgaaaggcaccattgatg

SEQ ID NO: 117546 - DNA, 25 bp, mus musculus
tttgctgacctggctccacagaagc

SEQ ID NO: 117547 - DNA, 25 bp, mus musculus
tgctgacctggctccacagaagccg

SEQ ID NO: 117548 - DNA, 25 bp, mus musculus
cccacttgacacagacagatttgtg

SEQ ID NO: 117549 - DNA, 25 bp, mus musculus
agacagatttgtgctactggtatcc

SEQ ID NO: 117550 - DNA, 25 bp, mus musculus
atttgtgctactggtatccggactg

SEQ ID NO: 117551 - DNA, 25 bp, mus musculus
gtgctactggtatccggactgggcc

SEQ ID NO: 117552 - DNA, 25 bp, mus musculus
gctactggtatccggactgggcctg

SEQ ID NO: 117553 - DNA, 25 bp, mus musculus
tactggtatccggactgggcctggg

SEQ ID NO: 117554 - DNA, 25 bp, mus musculus
tgggcacccagctgctggtggacgt

SEQ ID NO: 117555 - DNA, 25 bp, mus musculus
cacccagctgctggtggacgtggtg

SEQ ID NO: 117556 - DNA, 25 bp, mus musculus
cttggccgtgttgggctctgcgaaa

SEQ ID NO: 117557 - DNA, 25 bp, mus musculus
cgtgttgggctctgcgaaagatgac

SEQ ID NO: 117558 - DNA, 25 bp, mus musculus
tgttgggctctgcgaaagatgacgg

SEQ ID NO: 117559 - DNA, 25 bp, mus musculus
ttgaagaccactgctttgctgacct

SEQ ID NO: 117560 - DNA, 25 bp, mus musculus
gaagaccactgctttgctgacctgg

SEQ ID NO: 117561 - DNA, 25 bp, mus musculus
agaccactgctttgctgacctggct

SEQ ID NO: 117562 - DNA, 25 bp, mus musculus
ctgctttgctgacctggctccacag

SEQ ID NO: 117563 - DNA, 25 bp, mus musculus
gctttgctgacctggctccacagaa

SEQ ID NO: 117564 - DNA, 25 bp, mus musculus
gacctgcgcttccagagctcggccg

SEQ ID NO: 117565 - DNA, 25 bp, mus musculus
cgcttccagagctcggccgtcatgg

SEQ ID NO: 117566 - DNA, 25 bp, mus musculus
gtcttattcagacgcctagcttgtt

SEQ ID NO: 117567 - DNA, 25 bp, mus musculus
cttattcagacgcctagcttgttaa

SEQ ID NO: 117568 - DNA, 25 bp, mus musculus
tattcagacgcctagcttgttaacc

SEQ ID NO: 117569 - DNA, 25 bp, mus musculus
ttcagacgcctagcttgttaacccg

SEQ ID NO: 117570 - DNA, 25 bp, mus musculus
agtaggttcaccagctcagtctaag

SEQ ID NO: 117571 - DNA, 25 bp, mus musculus
taggttcaccagctcagtctaaggg

SEQ ID NO: 117572 - DNA, 25 bp, mus musculus
atgtaatgttcctacccagctggag

SEQ ID NO: 117573 - DNA, 25 bp, mus musculus
gtaatgttcctacccagctggagca

SEQ ID NO: 117574 - DNA, 25 bp, mus musculus
tacccagctggagcagagaaggctt

SEQ ID NO: 117575 - DNA, 25 bp, mus musculus
cccagctggagcagagaaggctttg

SEQ ID NO: 117576 - DNA, 25 bp, mus musculus
cttccagagctcggccgtcatggcg

SEQ ID NO: 117577 - DNA, 25 bp, mus musculus
ttaagcgccctgtctcccatccatt

SEQ ID NO: 117578 - DNA, 25 bp, mus musculus
tttgaatgcccttagtgtaagttgt

SEQ ID NO: 117579 - DNA, 25 bp, mus musculus
tgaatgcccttagtgtaagttgttt

SEQ ID NO: 117580 - DNA, 25 bp, mus musculus
taacgttaactgcggtcttattcag

SEQ ID NO: 117581 - DNA, 25 bp, mus musculus
gttaactgcggtcttattcagacgc

SEQ ID NO: 117582 - DNA, 25 bp, mus musculus
taactgcggtcttattcagacgcct

SEQ ID NO: 117583 - DNA, 25 bp, mus musculus
actgcggtcttattcagacgcctag

SEQ ID NO: 117584 - DNA, 25 bp, mus musculus
atcctacaccttctatgcagacaaa

SEQ ID NO: 117585 - DNA, 25 bp, mus musculus
cctacaccttctatgcagacaaatg

SEQ ID NO: 117586 - DNA, 25 bp, mus musculus
cggaatccgaaggccctgctcctct

SEQ ID NO: 117587 - DNA, 25 bp, mus musculus
gaatccgaaggccctgctcctctga

SEQ ID NO: 117588 - DNA, 25 bp, mus musculus
atccgaaggccctgctcctctgagg

SEQ ID NO: 117589 - DNA, 25 bp, mus musculus
gaaggccctgctcctctgaggcact

SEQ ID NO: 117590 - DNA, 25 bp, mus musculus
ctcctctgaggcactgtcaaagaag

SEQ ID NO: 117591 - DNA, 25 bp, mus musculus
agaaggagctgtctgccgaggagct

SEQ ID NO: 117592 - DNA, 25 bp, mus musculus
agctgtctgccgaggagctgtctca

SEQ ID NO: 117593 - DNA, 25 bp, mus musculus
gagctgtctcagcgcctggaaaagc

SEQ ID NO: 117594 - DNA, 25 bp, mus musculus
tgtctcagcgcctggaaaagctcat

SEQ ID NO: 117595 - DNA, 25 bp, mus musculus
aaagctcatcatggaggagaaagcg

SEQ ID NO: 117596 - DNA, 25 bp, mus musculus
caccttctatgcagacaaatgagcc

SEQ ID NO: 117597 - DNA, 25 bp, mus musculus
ccttctatgcagacaaatgagccat

SEQ ID NO: 117598 - DNA, 25 bp, mus musculus
aggctgacctcagctggaaggactt

SEQ ID NO: 117599 - DNA, 25 bp, mus musculus
gctgacctcagctggaaggactttt

SEQ ID NO: 117600 - DNA, 25 bp, mus musculus
tgacctcagctggaaggacttttta

SEQ ID NO: 117601 - DNA, 25 bp, mus musculus
aagatgtccatcattttctcttgga

SEQ ID NO: 117602 - DNA, 25 bp, mus musculus
tcattttctcttggagcagaagttg

SEQ ID NO: 117603 - DNA, 25 bp, mus musculus
tttctcttggagcagaagttggact

SEQ ID NO: 117604 - DNA, 25 bp, mus musculus
tggtactgattgcccatcttgagtg

SEQ ID NO: 117605 - DNA, 25 bp, mus musculus
cctggccagtgctaatgccagaagg

SEQ ID NO: 117606 - DNA, 25 bp, mus musculus
taatctacgatttctcagcgccacg

SEQ ID NO: 117607 - DNA, 25 bp, mus musculus
tctacgatttctcagcgccacgtgc

SEQ ID NO: 117608 - DNA, 25 bp, mus musculus
atttctcagcgccacgtgccgcagg

SEQ ID NO: 117609 - DNA, 25 bp, mus musculus
ccatctccctctgaactagttagtg

SEQ ID NO: 117610 - DNA, 25 bp, mus musculus
tctccctctgaactagttagtgatg

SEQ ID NO: 117611 - DNA, 25 bp, mus musculus
tagacatcaatcgtgtgtcctgatt

SEQ ID NO: 117612 - DNA, 25 bp, mus musculus
acatcaatcgtgtgtcctgatttga

SEQ ID NO: 117613 - DNA, 25 bp, mus musculus
tgtctctactcattttataccactg

SEQ ID NO: 117614 - DNA, 25 bp, mus musculus
ctctactcattttataccactgttt

SEQ ID NO: 117615 - DNA, 25 bp, mus musculus
tcattttataccactgtttgaatgg

SEQ ID NO: 117616 - DNA, 25 bp, mus musculus
tgtcagccttggagattagcagagc

SEQ ID NO: 117617 - DNA, 25 bp, mus musculus
ttagcagagcctctgtttgaggcct

SEQ ID NO: 117618 - DNA, 25 bp, mus musculus
gagcctctgtttgaggccttagagg

SEQ ID NO: 117619 - DNA, 25 bp, mus musculus
cctctgtttgaggccttagaggtat

SEQ ID NO: 117620 - DNA, 25 bp, mus musculus
gagactgcccagcagcgttgttgct

SEQ ID NO: 117621 - DNA, 25 bp, mus musculus
actgcccagcagcgttgttgctttt

SEQ ID NO: 117622 - DNA, 25 bp, mus musculus
gcccagcagcgttgttgcttttgga

SEQ ID NO: 117623 - DNA, 25 bp, mus musculus
gatggtccctaatctacgatttctc

SEQ ID NO: 117624 - DNA, 25 bp, mus musculus
tgcttccttctcatttggcctcact

SEQ ID NO: 117625 - DNA, 25 bp, mus musculus
atttggcctcactcccttctgaaga

SEQ ID NO: 117626 - DNA, 25 bp, mus musculus
gacttaaatgtcagggctggagatg

SEQ ID NO: 117627 - DNA, 25 bp, mus musculus
ctcaggtgggctgtcccaaagctcc

SEQ ID NO: 117628 - DNA, 25 bp, mus musculus
tacagctcttccctagtcttaagca

SEQ ID NO: 117629 - DNA, 25 bp, mus musculus
agctcttccctagtcttaagcacag

SEQ ID NO: 117630 - DNA, 25 bp, mus musculus
tccctagtcttaagcacagctaggc

SEQ ID NO: 117631 - DNA, 25 bp, mus musculus
ctagtcttaagcacagctaggctgg

SEQ ID NO: 117632 - DNA, 25 bp, mus musculus
gtcttaagcacagctaggctgggag

SEQ ID NO: 117633 - DNA, 25 bp, mus musculus
gctgggctgcatggtttttgccctg

SEQ ID NO: 117634 - DNA, 25 bp, mus musculus
tcccatctttcacttgcacataaag

SEQ ID NO: 117635 - DNA, 25 bp, mus musculus
ctttcacttgcacataaagttgctt

SEQ ID NO: 117636 - DNA, 25 bp, mus musculus
tgacagcctttatcctctcagactt

SEQ ID NO: 117637 - DNA, 25 bp, mus musculus
ttatcctctcagacttgacagatgg

SEQ ID NO: 117638 - DNA, 25 bp, mus musculus
ggacctgcctctgtctcctgtcagc

SEQ ID NO: 117639 - DNA, 25 bp, mus musculus
tcctgcagtcagactgaagaataaa

SEQ ID NO: 117640 - DNA, 25 bp, mus musculus
tttaatttcctgtgaggagagactg

SEQ ID NO: 117641 - DNA, 25 bp, mus musculus
aatttcctgtgaggagagactggga

SEQ ID NO: 117642 - DNA, 25 bp, mus musculus
agaagtactgtacatccccaggttg

SEQ ID NO: 117643 - DNA, 25 bp, mus musculus
gtacatccccaggttgacttaaatg

SEQ ID NO: 117644 - DNA, 25 bp, mus musculus
ctagccattgagcttctcgcggcct

SEQ ID NO: 117645 - DNA, 25 bp, mus musculus
gatcgcttcatggccccggacattg

SEQ ID NO: 117646 - DNA, 25 bp, mus musculus
atcccagagtctgacgatctttaac

SEQ ID NO: 117647 - DNA, 25 bp, mus musculus
gagtctgacgatctttaacgggctt

SEQ ID NO: 117648 - DNA, 25 bp, mus musculus
ggcacatcagatgggcctgagctta

SEQ ID NO: 117649 - DNA, 25 bp, mus musculus
gagcttagcacagcactggtgtgtt

SEQ ID NO: 117650 - DNA, 25 bp, mus musculus
agcacagcactggtgtgttgatgga

SEQ ID NO: 117651 - DNA, 25 bp, mus musculus
agtctcaggaactgcctgtaatgtg

SEQ ID NO: 117652 - DNA, 25 bp, mus musculus
ctcatctcttttcaaacatactctg

SEQ ID NO: 117653 - DNA, 25 bp, mus musculus
tactctggataggccatggcagcaa

SEQ ID NO: 117654 - DNA, 25 bp, mus musculus
tggctgaacccagagccctgatctt

SEQ ID NO: 117655 - DNA, 25 bp, mus musculus
gagccctgatcttgttttcttgtta

SEQ ID NO: 117656 - DNA, 25 bp, mus musculus
ttcatggccccggacattgaggcag

SEQ ID NO: 117657 - DNA, 25 bp, mus musculus
gcacacaggttgcttcttgaccaaa

SEQ ID NO: 117658 - DNA, 25 bp, mus musculus
gttgccgcaccgtacatcgagaaat

SEQ ID NO: 117659 - DNA, 25 bp, mus musculus
tccagaccgctttctccaacagcgt

SEQ ID NO: 117660 - DNA, 25 bp, mus musculus
tctccaacagcgttttcactagaat

SEQ ID NO: 117661 - DNA, 25 bp, mus musculus
ttttcactagaatctctccgaaaga

SEQ ID NO: 117662 - DNA, 25 bp, mus musculus
ctagaatctctccgaaagaactcag

SEQ ID NO: 117663 - DNA, 25 bp, mus musculus
tctctccgaaagaactcagccacaa

SEQ ID NO: 117664 - DNA, 25 bp, mus musculus
atctgcctgccttccaaagactaca

SEQ ID NO: 117665 - DNA, 25 bp, mus musculus
tccaaagactacatagcaccaggcc

SEQ ID NO: 117666 - DNA, 25 bp, mus musculus
ctcaccaagtaccaggaagacacct

SEQ ID NO: 117667 - DNA, 25 bp, mus musculus
tgctacggtgacgccggcagtgcct

SEQ ID NO: 117668 - DNA, 25 bp, mus musculus
gccggcagtgcctttgccattcatg

SEQ ID NO: 117669 - DNA, 25 bp, mus musculus
aagagctgcgctgtcgctgagtatg

SEQ ID NO: 117670 - DNA, 25 bp, mus musculus
tgcgctgtcgctgagtatggtgtgt

SEQ ID NO: 117671 - DNA, 25 bp, mus musculus
cactagaaggctgcacatggcaggg

SEQ ID NO: 117672 - DNA, 25 bp, mus musculus
aaggctgcacatggcagggcaggct

SEQ ID NO: 117673 - DNA, 25 bp, mus musculus
gctatactctgatgggttctagccc

SEQ ID NO: 117674 - DNA, 25 bp, mus musculus
ctctgatgggttctagccctgcact

SEQ ID NO: 117675 - DNA, 25 bp, mus musculus
ctagccctgcactgctcagtcaaca

SEQ ID NO: 117676 - DNA, 25 bp, mus musculus
gactacatagcaccaggccgtgtgg

SEQ ID NO: 117677 - DNA, 25 bp, mus musculus
atagcaccaggccgtgtgggctacg

SEQ ID NO: 117678 - DNA, 25 bp, mus musculus
agatttaccgatcgtctcaagtatg

SEQ ID NO: 117679 - DNA, 25 bp, mus musculus
accgatcgtctcaagtatgtcatgc

SEQ ID NO: 117680 - DNA, 25 bp, mus musculus
ggggtccagcctatcttgaacgagc

SEQ ID NO: 117681 - DNA, 25 bp, mus musculus
cagcctatcttgaacgagcacacct

SEQ ID NO: 117682 - DNA, 25 bp, mus musculus
ttctgtgctggcctcaccaagtacc

SEQ ID NO: 117683 - DNA, 25 bp, mus musculus
gctggcctcaccaagtaccaggaag

SEQ ID NO: 117684 - DNA, 25 bp, mus musculus
gaccaatcactgcattcagaaagag

SEQ ID NO: 117685 - DNA, 25 bp, mus musculus
caatcactgcattcagaaagagtac

SEQ ID NO: 117686 - DNA, 25 bp, mus musculus
ccagagcttccagctcctcggcttt

SEQ ID NO: 117687 - DNA, 25 bp, mus musculus
gagcttccagctcctcggctttgac

SEQ ID NO: 117688 - DNA, 25 bp, mus musculus
cttccagctcctcggctttgacttc

SEQ ID NO: 117689 - DNA, 25 bp, mus musculus
ccagctcctcggctttgacttcatg

SEQ ID NO: 117690 - DNA, 25 bp, mus musculus
gctcctcggctttgacttcatggtg

SEQ ID NO: 117691 - DNA, 25 bp, mus musculus
cctcggctttgacttcatggtggac

SEQ ID NO: 117692 - DNA, 25 bp, mus musculus
cggctttgacttcatggtggacgag

SEQ ID NO: 117693 - DNA, 25 bp, mus musculus
ctttgacttcatggtggacgaggag

SEQ ID NO: 117694 - DNA, 25 bp, mus musculus
tgacttcatggtggacgaggagctg

SEQ ID NO: 117695 - DNA, 25 bp, mus musculus
tgaagtcaacggcgccacagcgtgt

SEQ ID NO: 117696 - DNA, 25 bp, mus musculus
gttcaatcagtacctaaccagcgct

SEQ ID NO: 117697 - DNA, 25 bp, mus musculus
agtcaacggcgccacagcgtgtgcc

SEQ ID NO: 117698 - DNA, 25 bp, mus musculus
cgctctgaacatcaccttagaaagt

SEQ ID NO: 117699 - DNA, 25 bp, mus musculus
tctgaacatcaccttagaaagtagc

SEQ ID NO: 117700 - DNA, 25 bp, mus musculus
gaacatcaccttagaaagtagcatt

SEQ ID NO: 117701 - DNA, 25 bp, mus musculus
aaggagctgcctcatgagtgtggag

SEQ ID NO: 117702 - DNA, 25 bp, mus musculus
gagctgcctcatgagtgtggagccc

SEQ ID NO: 117703 - DNA, 25 bp, mus musculus
cctcatgagtgtggagcccgccatc

SEQ ID NO: 117704 - DNA, 25 bp, mus musculus
ttaccagagcttccagctcctcggc

SEQ ID NO: 117705 - DNA, 25 bp, mus musculus
aagcagctgagcctgaccatgatgg

SEQ ID NO: 117706 - DNA, 25 bp, mus musculus
atgatggcccaatggagccagtttg

SEQ ID NO: 117707 - DNA, 25 bp, mus musculus
gaccatgctgctgtgagcccatgtt

SEQ ID NO: 117708 - DNA, 25 bp, mus musculus
gctgctgtgagcccatgtttcttaa

SEQ ID NO: 117709 - DNA, 25 bp, mus musculus
ccatgtttcttaaatcatcagcccc

SEQ ID NO: 117710 - DNA, 25 bp, mus musculus
ttcttaaatcatcagcccctacaag

SEQ ID NO: 117711 - DNA, 25 bp, mus musculus
cagcccctacaagaccagtatggtg

SEQ ID NO: 117712 - DNA, 25 bp, mus musculus
aatctggtttctacttcttgatcat

SEQ ID NO: 117713 - DNA, 25 bp, mus musculus
gtttctacttcttgatcattgaaca

SEQ ID NO: 117714 - DNA, 25 bp, mus musculus
acttcttgatcattgaacatactgc

SEQ ID NO: 117715 - DNA, 25 bp, mus musculus
atactgctgtttcttcctaaagtga

SEQ ID NO: 117716 - DNA, 25 bp, mus musculus
acccttgctgtatggtacagtccag

SEQ ID NO: 117717 - DNA, 25 bp, mus musculus
gcacgcacaggaaatcccaatggca

SEQ ID NO: 117718 - DNA, 25 bp, mus musculus
aatcccaatggcaaggggctgcctc

SEQ ID NO: 117719 - DNA, 25 bp, mus musculus
aaagttccagaggagctctgagccc

SEQ ID NO: 117720 - DNA, 25 bp, mus musculus
cagacctacctggaccttcctgact

SEQ ID NO: 117721 - DNA, 25 bp, mus musculus
gtagcatccaagcagggcaactaca

SEQ ID NO: 117722 - DNA, 25 bp, mus musculus
tccaagcagggcaactacaacttct

SEQ ID NO: 117723 - DNA, 25 bp, mus musculus
tttctgttcagagactttagcctgg

SEQ ID NO: 117724 - DNA, 25 bp, mus musculus
gactttagcctggaccatgctgctg

SEQ ID NO: 117725 - DNA, 25 bp, mus musculus
tgatgcgctgcaaacgccggctcaa

SEQ ID NO: 117726 - DNA, 25 bp, mus musculus
gctgcaaacgccggctcaacttcag

SEQ ID NO: 117727 - DNA, 25 bp, mus musculus
ccaacgacttgaactctatggcggg

SEQ ID NO: 117728 - DNA, 25 bp, mus musculus
agctgctggactttaccaactggtt

SEQ ID NO: 117729 - DNA, 25 bp, mus musculus
tggactttaccaactggttctgagg

SEQ ID NO: 117730 - DNA, 25 bp, mus musculus
gacctgccaggctctcctgggaatg

SEQ ID NO: 117731 - DNA, 25 bp, mus musculus
ccaggctctcctgggaatggacttt

SEQ ID NO: 117732 - DNA, 25 bp, mus musculus
tctcctgggaatggactttggaagc

SEQ ID NO: 117733 - DNA, 25 bp, mus musculus
ggcagcagatcctgcatctttagtg

SEQ ID NO: 117734 - DNA, 25 bp, mus musculus
agatcctgcatctttagtgtttctt

SEQ ID NO: 117735 - DNA, 25 bp, mus musculus
tgcatctttagtgtttcttgacaac

SEQ ID NO: 117736 - DNA, 25 bp, mus musculus
gtttcttgacaacgacgtcaaaatg

SEQ ID NO: 117737 - DNA, 25 bp, mus musculus
aacgccggctcaacttcagcggctt

SEQ ID NO: 117738 - DNA, 25 bp, mus musculus
acttcagcggcttcggctacagcct

SEQ ID NO: 117739 - DNA, 25 bp, mus musculus
gcggcttcggctacagcctgccaca

SEQ ID NO: 117740 - DNA, 25 bp, mus musculus
ccaacggcgcggccaacaagaagat

SEQ ID NO: 117741 - DNA, 25 bp, mus musculus
tccagtacatccgcgcgctgcagca

SEQ ID NO: 117742 - DNA, 25 bp, mus musculus
agcacgacgcggtgagcgctgcctt

SEQ ID NO: 117743 - DNA, 25 bp, mus musculus
acgcggtgagcgctgcctttcaggc

SEQ ID NO: 117744 - DNA, 25 bp, mus musculus
actactccaacgacttgaactctat

SEQ ID NO: 117745 - DNA, 25 bp, mus musculus
gattaatcacctctctgtgagtgag

SEQ ID NO: 117746 - DNA, 25 bp, mus musculus
taatcacctctctgtgagtgaggtg

SEQ ID NO: 117747 - DNA, 25 bp, mus musculus
aactcattttccagagtgaaggcaa

SEQ ID NO: 117748 - DNA, 25 bp, mus musculus
aggaaggacccagtcttctgacagc

SEQ ID NO: 117749 - DNA, 25 bp, mus musculus
aaggacccagtcttctgacagcagg

SEQ ID NO: 117750 - DNA, 25 bp, mus musculus
gagaaagcacacacacaggtttgct

SEQ ID NO: 117751 - DNA, 25 bp, mus musculus
aaagcacacacacaggtttgctgcc

SEQ ID NO: 117752 - DNA, 25 bp, mus musculus
gcacacacacaggtttgctgccacg

SEQ ID NO: 117753 - DNA, 25 bp, mus musculus
cacacacaggtttgctgccacgttg

SEQ ID NO: 117754 - DNA, 25 bp, mus musculus
gtttgctgccacgttgccagtaatg

SEQ ID NO: 117755 - DNA, 25 bp, mus musculus
tgctgccacgttgccagtaatgagc

SEQ ID NO: 117756 - DNA, 25 bp, mus musculus
tgccacgttgccagtaatgagcagt

SEQ ID NO: 117757 - DNA, 25 bp, mus musculus
acgtgctaggcaagcaccgagccca

SEQ ID NO: 117758 - DNA, 25 bp, mus musculus
gagcccaggggtctcacatttaagc

SEQ ID NO: 117759 - DNA, 25 bp, mus musculus
ggtctcacatttaagccatcacatt

SEQ ID NO: 117760 - DNA, 25 bp, mus musculus
acatttaagccatcacattggacat

SEQ ID NO: 117761 - DNA, 25 bp, mus musculus
aagccatcacattggacatgaaggg

SEQ ID NO: 117762 - DNA, 25 bp, mus musculus
ccatcacattggacatgaaggggac

SEQ ID NO: 117763 - DNA, 25 bp, mus musculus
tcacattggacatgaaggggacact

SEQ ID NO: 117764 - DNA, 25 bp, mus musculus
tgggacaactcattttccagagtga

SEQ ID NO: 117765 - DNA, 25 bp, mus musculus
acctcacaccatggttcatttcaca

SEQ ID NO: 117766 - DNA, 25 bp, mus musculus
ggttcatttcacagctgaggagaag

SEQ ID NO: 117767 - DNA, 25 bp, mus musculus
agtgctgacatccctgggcttggca

SEQ ID NO: 117768 - DNA, 25 bp, mus musculus
cctgggcttggcagttaagaacatg

SEQ ID NO: 117769 - DNA, 25 bp, mus musculus
gaacatgcacaacctcaaggagacc

SEQ ID NO: 117770 - DNA, 25 bp, mus musculus
ctttgctcatctcagtgaactgcac

SEQ ID NO: 117771 - DNA, 25 bp, mus musculus
cttcaagctcctgggtaacatgctg

SEQ ID NO: 117772 - DNA, 25 bp, mus musculus
gctcctgggtaacatgctggtgatt

SEQ ID NO: 117773 - DNA, 25 bp, mus musculus
gtaccactgagccctttccctgatg

SEQ ID NO: 117774 - DNA, 25 bp, mus musculus
cctgatgtccagcattctgtacacc

SEQ ID NO: 117775 - DNA, 25 bp, mus musculus
ccatggccactgtgctggtctctga

SEQ ID NO: 117776 - DNA, 25 bp, mus musculus
aaagcagggcttctgcttaataaag

SEQ ID NO: 117777 - DNA, 25 bp, mus musculus
tttcacagctgaggagaaggcagct

SEQ ID NO: 117778 - DNA, 25 bp, mus musculus
tatcacaagcatctgggataaagtg

SEQ ID NO: 117779 - DNA, 25 bp, mus musculus
gctcctgattgtttacccatggact

SEQ ID NO: 117780 - DNA, 25 bp, mus musculus
gattgtttacccatggactcagagg

SEQ ID NO: 117781 - DNA, 25 bp, mus musculus
atggactcagaggttctttgacaaa

SEQ ID NO: 117782 - DNA, 25 bp, mus musculus
tgcccaagccatcatgggtaatccc

SEQ ID NO: 117783 - DNA, 25 bp, mus musculus
agccatcatgggtaatcccagaatc

SEQ ID NO: 117784 - DNA, 25 bp, mus musculus
taatcccagaatcaaagcccatggc

SEQ ID NO: 117785 - DNA, 25 bp, mus musculus
ccctcagcaccaggcaggatctgac

SEQ ID NO: 117786 - DNA, 25 bp, mus musculus
gcaccaggcaggatctgactcactg

SEQ ID NO: 117787 - DNA, 25 bp, mus musculus
tacgagttacacaactgcttgtata

SEQ ID NO: 117788 - DNA, 25 bp, mus musculus
ttacacaactgcttgtatataggtt

SEQ ID NO: 117789 - DNA, 25 bp, mus musculus
cttttgtagaccttctctgctttca

SEQ ID NO: 117790 - DNA, 25 bp, mus musculus
ttctctgctttcagtaataagtatg

SEQ ID NO: 117791 - DNA, 25 bp, mus musculus
aagtatggcctttcttagctatgat

SEQ ID NO: 117792 - DNA, 25 bp, mus musculus
ggcctttcttagctatgatcttaat

SEQ ID NO: 117793 - DNA, 25 bp, mus musculus
cattcaccttaaatctggccttaat

SEQ ID NO: 117794 - DNA, 25 bp, mus musculus
tttaatacacttcttatcaagcttg

SEQ ID NO: 117795 - DNA, 25 bp, mus musculus
cttatcaagcttgtgtgacaaagct

SEQ ID NO: 117796 - DNA, 25 bp, mus musculus
caaagctacattactgaataatttg

SEQ ID NO: 117797 - DNA, 25 bp, mus musculus
atctgactcactgcttacaggaatg

SEQ ID NO: 117798 - DNA, 25 bp, mus musculus
atactgtggtcacttatatggcctt

SEQ ID NO: 117799 - DNA, 25 bp, mus musculus
tggtcacttatatggccttggttct

SEQ ID NO: 117800 - DNA, 25 bp, mus musculus
cttatatggccttggttctggctca

SEQ ID NO: 117801 - DNA, 25 bp, mus musculus
tggttctggctcatcctatgtacag

SEQ ID NO: 117802 - DNA, 25 bp, mus musculus
tggctcatcctatgtacagaacggc

SEQ ID NO: 117803 - DNA, 25 bp, mus musculus
atcctatgtacagaacggcacaggg

SEQ ID NO: 117804 - DNA, 25 bp, mus musculus
tgtacagaacggcacagggaatgca

SEQ ID NO: 117805 - DNA, 25 bp, mus musculus
ccaccaaggggctagactgtgacat

SEQ ID NO: 117806 - DNA, 25 bp, mus musculus
ttgatatccagaagaccatccagat

SEQ ID NO: 117807 - DNA, 25 bp, mus musculus
agaagcagcggtcggcagacaagga

SEQ ID NO: 117808 - DNA, 25 bp, mus musculus
gttctctcaagaggaagtgatctgg

SEQ ID NO: 117809 - DNA, 25 bp, mus musculus
ggcattcgtctgcaggtggccatgc

SEQ ID NO: 117810 - DNA, 25 bp, mus musculus
cgtctgcaggtggccatgcatcagc

SEQ ID NO: 117811 - DNA, 25 bp, mus musculus
gccatgcatcagccgtgatccctgc

SEQ ID NO: 117812 - DNA, 25 bp, mus musculus
catcagccgtgatccctgcagaggc

SEQ ID NO: 117813 - DNA, 25 bp, mus musculus
cagaggcttccacccgatagactga

SEQ ID NO: 117814 - DNA, 25 bp, mus musculus
actgtggtcatctgaatctgtatat

SEQ ID NO: 117815 - DNA, 25 bp, mus musculus
atctgtatatagcccggcaagtccc

SEQ ID NO: 117816 - DNA, 25 bp, mus musculus
tgtatatagcccggcaagtccccag

SEQ ID NO: 117817 - DNA, 25 bp, mus musculus
tccagaagaccatccagatggtacg

SEQ ID NO: 117818 - DNA, 25 bp, mus musculus
gagcacagcgctccggcatggtgca

SEQ ID NO: 117819 - DNA, 25 bp, mus musculus
tttacgtggccattgcccagttcat

SEQ ID NO: 117820 - DNA, 25 bp, mus musculus
tggccattgcccagttcatcgaaac

SEQ ID NO: 117821 - DNA, 25 bp, mus musculus
ttgcccagttcatcgaaacgaccaa

SEQ ID NO: 117822 - DNA, 25 bp, mus musculus
agatcatacaatcccagaagggcca

SEQ ID NO: 117823 - DNA, 25 bp, mus musculus
tacaatcccagaagggccaggagtc

SEQ ID NO: 117824 - DNA, 25 bp, mus musculus
gtacttcctccaagcacaaggagga

SEQ ID NO: 117825 - DNA, 25 bp, mus musculus
gttttccaccagaggctatcaacaa

SEQ ID NO: 117826 - DNA, 25 bp, mus musculus
ttccaccagaggctatcaacaactt

SEQ ID NO: 117827 - DNA, 25 bp, mus musculus
atgcagccccacgtgccatggctgt

SEQ ID NO: 117828 - DNA, 25 bp, mus musculus
gtgccatggctgttctagagccact

SEQ ID NO: 117829 - DNA, 25 bp, mus musculus
agccactacaagttgtcatcaccaa

SEQ ID NO: 117830 - DNA, 25 bp, mus musculus
cactacaagttgtcatcaccaactt

SEQ ID NO: 117831 - DNA, 25 bp, mus musculus
ttgtcatcaccaactttcctgctcc

SEQ ID NO: 117832 - DNA, 25 bp, mus musculus
acatccgagtgccaaatttcccagc

SEQ ID NO: 117833 - DNA, 25 bp, mus musculus
gagtgccaaatttcccagctgatga

SEQ ID NO: 117834 - DNA, 25 bp, mus musculus
caaatttcccagctgatgagaccaa

SEQ ID NO: 117835 - DNA, 25 bp, mus musculus
atttcccagctgatgagaccaaggg

SEQ ID NO: 117836 - DNA, 25 bp, mus musculus
tcccagctgatgagaccaagggttt

SEQ ID NO: 117837 - DNA, 25 bp, mus musculus
ctatcaacaacttctgtgctcgggt

SEQ ID NO: 117838 - DNA, 25 bp, mus musculus
tcacagtggcacagaccacaatgga

SEQ ID NO: 117839 - DNA, 25 bp, mus musculus
cagtggcacagaccacaatggaacc

SEQ ID NO: 117840 - DNA, 25 bp, mus musculus
tggcacagaccacaatggaacctca

SEQ ID NO: 117841 - DNA, 25 bp, mus musculus
ccacaatggaacctcatcttctgga

SEQ ID NO: 117842 - DNA, 25 bp, mus musculus
caatggaacctcatcttctggaagc

SEQ ID NO: 117843 - DNA, 25 bp, mus musculus
aacctcatcttctggaagcctgtgt

SEQ ID NO: 117844 - DNA, 25 bp, mus musculus
aagcctgtgtgcgtgatgtgctgaa

SEQ ID NO: 117845 - DNA, 25 bp, mus musculus
tgatccccatgggcctggctcgaag

SEQ ID NO: 117846 - DNA, 25 bp, mus musculus
tatttcctatgctgggctctgtgct

SEQ ID NO: 117847 - DNA, 25 bp, mus musculus
tcgatgtgtctcctagactcgtggg

SEQ ID NO: 117848 - DNA, 25 bp, mus musculus
tgtctcctagactcgtgggctttgt

SEQ ID NO: 117849 - DNA, 25 bp, mus musculus
ctagactcgtgggctttgtcacgat

SEQ ID NO: 117850 - DNA, 25 bp, mus musculus
gctttgtcacgatcccaccaaccta

SEQ ID NO: 117851 - DNA, 25 bp, mus musculus
caacctacactatgagtttcttgtc

SEQ ID NO: 117852 - DNA, 25 bp, mus musculus
tcttgtcccgttgatcctgggctgc

SEQ ID NO: 117853 - DNA, 25 bp, mus musculus
cccgttgatcctgggctgcatgagg

SEQ ID NO: 117854 - DNA, 25 bp, mus musculus
gatcctgggctgcatgaggttaaag

SEQ ID NO: 117855 - DNA, 25 bp, mus musculus
ggacacttcgtagacttgcagagga

SEQ ID NO: 117856 - DNA, 25 bp, mus musculus
cacttcgtagacttgcagaggatat

SEQ ID NO: 117857 - DNA, 25 bp, mus musculus
ctatgctgggctctgtgctgaaaga

SEQ ID NO: 117858 - DNA, 25 bp, mus musculus
atgcctttgtgcccttttccattgg

SEQ ID NO: 117859 - DNA, 25 bp, mus musculus
tggaactcttcctcttcctcacaaa

SEQ ID NO: 117860 - DNA, 25 bp, mus musculus
tcttcctcacaaacatcatgcagaa

SEQ ID NO: 117861 - DNA, 25 bp, mus musculus
tcacaaacatcatgcagaacttcca

SEQ ID NO: 117862 - DNA, 25 bp, mus musculus
acatcatgcagaacttccacttcaa

SEQ ID NO: 117863 - DNA, 25 bp, mus musculus
acttccacttcaaatccacacaggc

SEQ ID NO: 117864 - DNA, 25 bp, mus musculus
caccccaggacatcgatgtgtctcc

SEQ ID NO: 117865 - DNA, 25 bp, mus musculus
ccacctgctgagtagtgcctgtggg

SEQ ID NO: 117866 - DNA, 25 bp, mus musculus
caggagcctgctccaagcttctgct

SEQ ID NO: 117867 - DNA, 25 bp, mus musculus
aagtcctagctcttgccagatggtt

SEQ ID NO: 117868 - DNA, 25 bp, mus musculus
tagctcttgccagatggttctgagc

SEQ ID NO: 117869 - DNA, 25 bp, mus musculus
ttgccagatggttctgagcccgcct

SEQ ID NO: 117870 - DNA, 25 bp, mus musculus
tgctccactgggctggagagctccc

SEQ ID NO: 117871 - DNA, 25 bp, mus musculus
ctcccacatttacccagtaggcata

SEQ ID NO: 117872 - DNA, 25 bp, mus musculus
catttacccagtaggcatacctgcc

SEQ ID NO: 117873 - DNA, 25 bp, mus musculus
acctgccacaccagtgtctggacac

SEQ ID NO: 117874 - DNA, 25 bp, mus musculus
cacaccagtgtctggacacaaaatg

SEQ ID NO: 117875 - DNA, 25 bp, mus musculus
gccaggtgtccagcaccattttcct

SEQ ID NO: 117876 - DNA, 25 bp, mus musculus
tgtccagcaccattttcctttctgt

SEQ ID NO: 117877 - DNA, 25 bp, mus musculus
cctgctccaagcttctgctggggct

SEQ ID NO: 117878 - DNA, 25 bp, mus musculus
ttctgctggggctgccttggccgtg

SEQ ID NO: 117879 - DNA, 25 bp, mus musculus
acagtgctaggttgaccaggtgttt

SEQ ID NO: 117880 - DNA, 25 bp, mus musculus
tttcctagtgttcccctggccatag

SEQ ID NO: 117881 - DNA, 25 bp, mus musculus
agtgttcccctggccatagtcgcca

SEQ ID NO: 117882 - DNA, 25 bp, mus musculus
aggttgcagctgccctggtatgtgg

SEQ ID NO: 117883 - DNA, 25 bp, mus musculus
cagctgccctggtatgtggatcaga

SEQ ID NO: 117884 - DNA, 25 bp, mus musculus
gatcagaagtcctagctcttgccag

SEQ ID NO: 117885 - DNA, 25 bp, mus musculus
agaactcactgcttttctctgctcc

SEQ ID NO: 117886 - DNA, 25 bp, mus musculus
tcacaccaaactcctagctctacaa

SEQ ID NO: 117887 - DNA, 25 bp, mus musculus
ctttctctagtgcaagtatgtgtgg

SEQ ID NO: 117888 - DNA, 25 bp, mus musculus
tggaatagtgtcccttctcagcctc

SEQ ID NO: 117889 - DNA, 25 bp, mus musculus
ctccagtcctgtgtactccattcct

SEQ ID NO: 117890 - DNA, 25 bp, mus musculus
cagtcctgtgtactccattcctctt

SEQ ID NO: 117891 - DNA, 25 bp, mus musculus
tcctgtgtactccattcctcttacc

SEQ ID NO: 117892 - DNA, 25 bp, mus musculus
caccaagagcagaccctgggatctg

SEQ ID NO: 117893 - DNA, 25 bp, mus musculus
accctgggatctgtgtctggtgtcc

SEQ ID NO: 117894 - DNA, 25 bp, mus musculus
ctgggatctgtgtctggtgtcctgt

SEQ ID NO: 117895 - DNA, 25 bp, mus musculus
tggttgcattcctaatttcctacaa

SEQ ID NO: 117896 - DNA, 25 bp, mus musculus
aaagtgacctcgatctagtaccaga

SEQ ID NO: 117897 - DNA, 25 bp, mus musculus
actcctagctctacaaggatattta

SEQ ID NO: 117898 - DNA, 25 bp, mus musculus
tattaccgagttatgcactttgggg

SEQ ID NO: 117899 - DNA, 25 bp, mus musculus
gggctccttgcagcttgctttagct

SEQ ID NO: 117900 - DNA, 25 bp, mus musculus
ctccttgcagcttgctttagctgag

SEQ ID NO: 117901 - DNA, 25 bp, mus musculus
gcagcttgctttagctgaggtcctc

SEQ ID NO: 117902 - DNA, 25 bp, mus musculus
gcttgctttagctgaggtcctcttg

SEQ ID NO: 117903 - DNA, 25 bp, mus musculus
cttcttctttctctagtgcaagtat

SEQ ID NO: 117904 - DNA, 25 bp, mus musculus
cttctttctctagtgcaagtatgtg

SEQ ID NO: 117905 - DNA, 25 bp, mus musculus
gcctccagcagtcttcagcgccttt

SEQ ID NO: 117906 - DNA, 25 bp, mus musculus
tccagcagtcttcagcgcctttctt

SEQ ID NO: 117907 - DNA, 25 bp, mus musculus
ctcacagatgccagcttttatgaaa

SEQ ID NO: 117908 - DNA, 25 bp, mus musculus
acagatgccagcttttatgaaaggc

SEQ ID NO: 117909 - DNA, 25 bp, mus musculus
atatcggaacgcctagtagcttagc

SEQ ID NO: 117910 - DNA, 25 bp, mus musculus
gaacgcctagtagcttagctctaga

SEQ ID NO: 117911 - DNA, 25 bp, mus musculus
cgcctagtagcttagctctagaacc

SEQ ID NO: 117912 - DNA, 25 bp, mus musculus
gcttagctctagaaccctgattttg

SEQ ID NO: 117913 - DNA, 25 bp, mus musculus
tttactatgatcacgtgaccctttt

SEQ ID NO: 117914 - DNA, 25 bp, mus musculus
actatgatcacgtgacccttttttg

SEQ ID NO: 117915 - DNA, 25 bp, mus musculus
agttcattcctgtctaaatcaaaga

SEQ ID NO: 117916 - DNA, 25 bp, mus musculus
ttcctgtctaaatcaaagagagaac

SEQ ID NO: 117917 - DNA, 25 bp, mus musculus
cttcagcgcctttcttccatcgtgg

SEQ ID NO: 117918 - DNA, 25 bp, mus musculus
cagcgcctttcttccatcgtggaca

SEQ ID NO: 117919 - DNA, 25 bp, mus musculus
cgcctttcttccatcgtggacagta

SEQ ID NO: 117920 - DNA, 25 bp, mus musculus
aagtaactcagccagcatttggaac

SEQ ID NO: 117921 - DNA, 25 bp, mus musculus
ctcagccagcatttggaacattctt

SEQ ID NO: 117922 - DNA, 25 bp, mus musculus
ttggaacattcttcacccagcagga

SEQ ID NO: 117923 - DNA, 25 bp, mus musculus
gaacattcttcacccagcaggaaga

SEQ ID NO: 117924 - DNA, 25 bp, mus musculus
ttagggctcacagatgccagctttt

SEQ ID NO: 117925 - DNA, 25 bp, mus musculus
tgctttcttcagtatccccggctgt

SEQ ID NO: 117926 - DNA, 25 bp, mus musculus
gctttcttcagtatccccggctgtt

SEQ ID NO: 117927 - DNA, 25 bp, mus musculus
ctaccctcctgtgagactgtcctgt

SEQ ID NO: 117928 - DNA, 25 bp, mus musculus
ccctcctgtgagactgtcctgtcca

SEQ ID NO: 117929 - DNA, 25 bp, mus musculus
ctcctgtgagactgtcctgtccagg

SEQ ID NO: 117930 - DNA, 25 bp, mus musculus
ctgtgagactgtcctgtccaggaaa

SEQ ID NO: 117931 - DNA, 25 bp, mus musculus
tgtgagactgtcctgtccaggaaat

SEQ ID NO: 117932 - DNA, 25 bp, mus musculus
gactgtcctgtccaggaaatctggg

SEQ ID NO: 117933 - DNA, 25 bp, mus musculus
caaccctgtaataggcaaggaggag

SEQ ID NO: 117934 - DNA, 25 bp, mus musculus
tttccattcgtggggaagaaggcag

SEQ ID NO: 117935 - DNA, 25 bp, mus musculus
tccattcgtggggaagaaggcagga

SEQ ID NO: 117936 - DNA, 25 bp, mus musculus
ggaaatcacagttcatcacttgagc

SEQ ID NO: 117937 - DNA, 25 bp, mus musculus
cttcagtatccccggctgtttccat

SEQ ID NO: 117938 - DNA, 25 bp, mus musculus
gaaatcacagttcatcacttgagca

SEQ ID NO: 117939 - DNA, 25 bp, mus musculus
ttcagtatccccggctgtttccatg

SEQ ID NO: 117940 - DNA, 25 bp, mus musculus
cagtatccccggctgtttccatggc

SEQ ID NO: 117941 - DNA, 25 bp, mus musculus
tatccccggctgtttccatggccag

SEQ ID NO: 117942 - DNA, 25 bp, mus musculus
cccggctgtttccatggccagcagc

SEQ ID NO: 117943 - DNA, 25 bp, mus musculus
ctgtttccatggccagcagccgccg

SEQ ID NO: 117944 - DNA, 25 bp, mus musculus
tagcagcttcagcatggaagaggag

SEQ ID NO: 117945 - DNA, 25 bp, mus musculus
cagcttcagcatggaagaggagtcc

SEQ ID NO: 117946 - DNA, 25 bp, mus musculus
gactgcatcatggaggcgcgtttca

SEQ ID NO: 117947 - DNA, 25 bp, mus musculus
ctgcatcatggaggcgcgtttcaca

SEQ ID NO: 117948 - DNA, 25 bp, mus musculus
cagcactgtcagagccgcgttttct

SEQ ID NO: 117949 - DNA, 25 bp, mus musculus
gcactgtcagagccgcgttttctct

SEQ ID NO: 117950 - DNA, 25 bp, mus musculus
tctctgtggccgagcttcaagcacg

SEQ ID NO: 117951 - DNA, 25 bp, mus musculus
tctgtggccgagcttcaagcacgct

SEQ ID NO: 117952 - DNA, 25 bp, mus musculus
tggccgagcttcaagcacgcttggc

SEQ ID NO: 117953 - DNA, 25 bp, mus musculus
agcttcaagcacgcttggctgccct

SEQ ID NO: 117954 - DNA, 25 bp, mus musculus
tcaagcacgcttggctgccctgggc

SEQ ID NO: 117955 - DNA, 25 bp, mus musculus
aagcacgcttggctgccctgggccg

SEQ ID NO: 117956 - DNA, 25 bp, mus musculus
ctgccctgggccgacaagtgggcgc

SEQ ID NO: 117957 - DNA, 25 bp, mus musculus
tgggcgcccgagtcctagatgccct

SEQ ID NO: 117958 - DNA, 25 bp, mus musculus
tcacacgcgggaagtcggcgctgct

SEQ ID NO: 117959 - DNA, 25 bp, mus musculus
cccgagtcctagatgccctggtggc

SEQ ID NO: 117960 - DNA, 25 bp, mus musculus
acacgcgggaagtcggcgctgctag

SEQ ID NO: 117961 - DNA, 25 bp, mus musculus
ctgagcgcctttgcccttctcttct

SEQ ID NO: 117962 - DNA, 25 bp, mus musculus
ttctcttctccgagctggtgcagca

SEQ ID NO: 117963 - DNA, 25 bp, mus musculus
ctcttctccgagctggtgcagcact

SEQ ID NO: 117964 - DNA, 25 bp, mus musculus
cttctccgagctggtgcagcactgt

SEQ ID NO: 117965 - DNA, 25 bp, mus musculus
tccgagctggtgcagcactgtcaga

SEQ ID NO: 117966 - DNA, 25 bp, mus musculus
tgcagcactgtcagagccgcgtttt

SEQ ID NO: 117967 - DNA, 25 bp, mus musculus
cgatctgctctacgagggctaccgg

SEQ ID NO: 117968 - DNA, 25 bp, mus musculus
tctgctctacgagggctaccgggct

SEQ ID NO: 117969 - DNA, 25 bp, mus musculus
gatgcaagcccagatgcagcagagc

SEQ ID NO: 117970 - DNA, 25 bp, mus musculus
agcccagatgcagcagagccaggct

SEQ ID NO: 117971 - DNA, 25 bp, mus musculus
ccaggctcagggcgagcaatcagat

SEQ ID NO: 117972 - DNA, 25 bp, mus musculus
ctctgctcaccgctaatcggctatc

SEQ ID NO: 117973 - DNA, 25 bp, mus musculus
tgctcaccgctaatcggctatccca

SEQ ID NO: 117974 - DNA, 25 bp, mus musculus
ggcctgcccttgcacttaaaccaga

SEQ ID NO: 117975 - DNA, 25 bp, mus musculus
ctgcccttgcacttaaaccagatcc

SEQ ID NO: 117976 - DNA, 25 bp, mus musculus
ctctaagaggaccgcactccaagaa

SEQ ID NO: 117977 - DNA, 25 bp, mus musculus
tattcctccaagttctccatctaat

SEQ ID NO: 117978 - DNA, 25 bp, mus musculus
tcctccaagttctccatctaataaa

SEQ ID NO: 117979 - DNA, 25 bp, mus musculus
caagctttcccggcaaagtgccaca

SEQ ID NO: 117980 - DNA, 25 bp, mus musculus
ttcccggcaaagtgccacagagatc

SEQ ID NO: 117981 - DNA, 25 bp, mus musculus
aagtgccacagagatcccgctgccc

SEQ ID NO: 117982 - DNA, 25 bp, mus musculus
agagatcccgctgcccatgttgcct

SEQ ID NO: 117983 - DNA, 25 bp, mus musculus
gatcccgctgcccatgttgcctctg

SEQ ID NO: 117984 - DNA, 25 bp, mus musculus
catgttgcctctggctgacactgaa

SEQ ID NO: 117985 - DNA, 25 bp, mus musculus
gttgcctctggctgacactgaaaag

SEQ ID NO: 117986 - DNA, 25 bp, mus musculus
gctgcgccgcatgcaagaaatgctg

SEQ ID NO: 117987 - DNA, 25 bp, mus musculus
accagaggtcacctgccaagatggt

SEQ ID NO: 117988 - DNA, 25 bp, mus musculus
ccagaggtcacctgccaagatggtt

SEQ ID NO: 117989 - DNA, 25 bp, mus musculus
tttgctgcacatgcttaaaaatctg

SEQ ID NO: 117990 - DNA, 25 bp, mus musculus
ttgctgcacatgcttaaaaatctga

SEQ ID NO: 117991 - DNA, 25 bp, mus musculus
tgctgcacatgcttaaaaatctgag

SEQ ID NO: 117992 - DNA, 25 bp, mus musculus
tgcacatgcttaaaaatctgagagt

SEQ ID NO: 117993 - DNA, 25 bp, mus musculus
tgaacaagtcacctaagattctccg

SEQ ID NO: 117994 - DNA, 25 bp, mus musculus
gaacaagtcacctaagattctccga

SEQ ID NO: 117995 - DNA, 25 bp, mus musculus
acaagtcacctaagattctccgacg

SEQ ID NO: 117996 - DNA, 25 bp, mus musculus
caagtcacctaagattctccgacga

SEQ ID NO: 117997 - DNA, 25 bp, mus musculus
tcacctaagattctccgacgaacct

SEQ ID NO: 117998 - DNA, 25 bp, mus musculus
tctccgacgaacctacagagctcat

SEQ ID NO: 117999 - DNA, 25 bp, mus musculus
cagaggtcacctgccaagatggttc

SEQ ID NO: 118000 - DNA, 25 bp, mus musculus
atgcatatcgcaaagcaccaagtat

SEQ ID NO: 118001 - DNA, 25 bp, mus musculus
tgcatatcgcaaagcaccaagtatc

SEQ ID NO: 118002 - DNA, 25 bp, mus musculus
gcatatcgcaaagcaccaagtatct

SEQ ID NO: 118003 - DNA, 25 bp, mus musculus
catatcgcaaagcaccaagtatctg

SEQ ID NO: 118004 - DNA, 25 bp, mus musculus
tatcgcaaagcaccaagtatctgaa

SEQ ID NO: 118005 - DNA, 25 bp, mus musculus
tgaatttttgctgcacatgcttaaa

SEQ ID NO: 118006 - DNA, 25 bp, mus musculus
ttttgctgcacatgcttaaaaatct

SEQ ID NO: 118007 - DNA, 25 bp, mus musculus
cgtctacgagtccgccaaagtcctg

SEQ ID NO: 118008 - DNA, 25 bp, mus musculus
cgagtccgccaaagtcctgaatgtg

SEQ ID NO: 118009 - DNA, 25 bp, mus musculus
tagcgctgcagatccatttcacgtt

SEQ ID NO: 118010 - DNA, 25 bp, mus musculus
tgcagatccatttcacgttgattca

SEQ ID NO: 118011 - DNA, 25 bp, mus musculus
tccatttcacgttgattcaggcgtt

SEQ ID NO: 118012 - DNA, 25 bp, mus musculus
tcacgttgattcaggcgttctgctg

SEQ ID NO: 118013 - DNA, 25 bp, mus musculus
tgattcaggcgttctgctgtgagaa

SEQ ID NO: 118014 - DNA, 25 bp, mus musculus
ttgatatcgtgcgcgtgggagacgt

SEQ ID NO: 118015 - DNA, 25 bp, mus musculus
gacctgcattgcatcctcatttcga

SEQ ID NO: 118016 - DNA, 25 bp, mus musculus
cattgcatcctcatttcgaatccta

SEQ ID NO: 118017 - DNA, 25 bp, mus musculus
atttcgaatcctaatgaggacacat

SEQ ID NO: 118018 - DNA, 25 bp, mus musculus
aatcctaatgaggacacatggaagg

SEQ ID NO: 118019 - DNA, 25 bp, mus musculus
cgccaaagtcctgaatgtggaccct

SEQ ID NO: 118020 - DNA, 25 bp, mus musculus
agtcctgaatgtggaccctgacaat

SEQ ID NO: 118021 - DNA, 25 bp, mus musculus
gaatgtggaccctgacaatgtgacc

SEQ ID NO: 118022 - DNA, 25 bp, mus musculus
ggaccctgacaatgtgaccttttgc

SEQ ID NO: 118023 - DNA, 25 bp, mus musculus
tgacaatgtgaccttttgcgtgctg

SEQ ID NO: 118024 - DNA, 25 bp, mus musculus
cttttgcgtgctggctgccgatgaa

SEQ ID NO: 118025 - DNA, 25 bp, mus musculus
cgtgctggctgccgatgaagaagat

SEQ ID NO: 118026 - DNA, 25 bp, mus musculus
ttgacatagcgctgcagatccattt

SEQ ID NO: 118027 - DNA, 25 bp, mus musculus
gtatctggggtcacggataacaaca

SEQ ID NO: 118028 - DNA, 25 bp, mus musculus
acggataacaacatcctggtgttag

SEQ ID NO: 118029 - DNA, 25 bp, mus musculus
tcaagcaactgcagactccaactgg

SEQ ID NO: 118030 - DNA, 25 bp, mus musculus
agactccaactgggcaggctggatt

SEQ ID NO: 118031 - DNA, 25 bp, mus musculus
ctggattacctggatcctacgtgct

SEQ ID NO: 118032 - DNA, 25 bp, mus musculus
gatcctacgtgcttcatgcactcct

SEQ ID NO: 118033 - DNA, 25 bp, mus musculus
acgtgcttcatgcactcctttcact

SEQ ID NO: 118034 - DNA, 25 bp, mus musculus
ttcatgcactcctttcactgagagc

SEQ ID NO: 118035 - DNA, 25 bp, mus musculus
cactcctttcactgagagctagact

SEQ ID NO: 118036 - DNA, 25 bp, mus musculus
aaatgtgatttctcttcaggtaaca

SEQ ID NO: 118037 - DNA, 25 bp, mus musculus
gatttctcttcaggtaacactacag

SEQ ID NO: 118038 - DNA, 25 bp, mus musculus
tcttcaggtaacactacagagtcat

SEQ ID NO: 118039 - DNA, 25 bp, mus musculus
atcctggtgttagtgccagactcac

SEQ ID NO: 118040 - DNA, 25 bp, mus musculus
gtgttagtgccagactcacgagccc

SEQ ID NO: 118041 - DNA, 25 bp, mus musculus
gactcacgagcccagaacacagctt

SEQ ID NO: 118042 - DNA, 25 bp, mus musculus
cgagcccagaacacagctttgcttg

SEQ ID NO: 118043 - DNA, 25 bp, mus musculus
cagaacacagctttgcttgaggaat

SEQ ID NO: 118044 - DNA, 25 bp, mus musculus
gttccaccatcgcttgaacagaacc

SEQ ID NO: 118045 - DNA, 25 bp, mus musculus
gccagctttactgcaacctcaagca

SEQ ID NO: 118046 - DNA, 25 bp, mus musculus
tttactgcaacctcaagcaactgca

SEQ ID NO: 118047 - DNA, 25 bp, mus musculus
ttcttgcgccagaagtacctggcct

SEQ ID NO: 118048 - DNA, 25 bp, mus musculus
ttgcgccagaagtacctggcctccg

SEQ ID NO: 118049 - DNA, 25 bp, mus musculus
tcgtcgctcttcgcgctgcagaatc

SEQ ID NO: 118050 - DNA, 25 bp, mus musculus
tcgctcttcgcgctgcagaatctgc

SEQ ID NO: 118051 - DNA, 25 bp, mus musculus
ctgcagccctgggcggaagacaaca

SEQ ID NO: 118052 - DNA, 25 bp, mus musculus
cagccctgggcggaagacaacaagg

SEQ ID NO: 118053 - DNA, 25 bp, mus musculus
ctcgcctcggtggtgtgaccgacac

SEQ ID NO: 118054 - DNA, 25 bp, mus musculus
gcctcggtggtgtgaccgacacctg

SEQ ID NO: 118055 - DNA, 25 bp, mus musculus
gtgtgaccgacacctgcccgacgag

SEQ ID NO: 118056 - DNA, 25 bp, mus musculus
gccgtaccgccagcgaagagtgagg

SEQ ID NO: 118057 - DNA, 25 bp, mus musculus
tcctctgaggctctttggtcatcag

SEQ ID NO: 118058 - DNA, 25 bp, mus musculus
gaggctctttggtcatcagtcggcc

SEQ ID NO: 118059 - DNA, 25 bp, mus musculus
cgccagaagtacctggcctccgcag

SEQ ID NO: 118060 - DNA, 25 bp, mus musculus
aagtacctggcctccgcagagaggg

SEQ ID NO: 118061 - DNA, 25 bp, mus musculus
atgacggacgcgcaggtcaagacct

SEQ ID NO: 118062 - DNA, 25 bp, mus musculus
ttccagaaccgacgcaccaagtggc

SEQ ID NO: 118063 - DNA, 25 bp, mus musculus
cgcctgctgctgcacctgcagcaag

SEQ ID NO: 118064 - DNA, 25 bp, mus musculus
ctgcacctgcagcaagacgcgctgc

SEQ ID NO: 118065 - DNA, 25 bp, mus musculus
gacccgctttgcctgcacaactcgt

SEQ ID NO: 118066 - DNA, 25 bp, mus musculus
aactcgtcgctcttcgcgctgcaga

SEQ ID NO: 118067 - DNA, 25 bp, mus musculus
tggccaagagcccaaagaaggcgaa

SEQ ID NO: 118068 - DNA, 25 bp, mus musculus
ggccaagagcccaaagaaggcgaag

SEQ ID NO: 118069 - DNA, 25 bp, mus musculus
gtaaagccaaaggctgccaagccca

SEQ ID NO: 118070 - DNA, 25 bp, mus musculus
taaagccaaaggctgccaagcccaa

SEQ ID NO: 118071 - DNA, 25 bp, mus musculus
agccaaaggctgccaagcccaaggt

SEQ ID NO: 118072 - DNA, 25 bp, mus musculus
gccaaaggctgccaagcccaaggtt

SEQ ID NO: 118073 - DNA, 25 bp, mus musculus
gctgccaagcccaaggttgccaagg

SEQ ID NO: 118074 - DNA, 25 bp, mus musculus
ctgccaagcccaaggttgccaaggc

SEQ ID NO: 118075 - DNA, 25 bp, mus musculus
tgccaagcccaaggttgccaaggcc

SEQ ID NO: 118076 - DNA, 25 bp, mus musculus
ttgccaaggccaagaaggttgcagc

SEQ ID NO: 118077 - DNA, 25 bp, mus musculus
taacaatccaaaaggctcttttcag

SEQ ID NO: 118078 - DNA, 25 bp, mus musculus
acaatccaaaaggctcttttcagag

SEQ ID NO: 118079 - DNA, 25 bp, mus musculus
gcgaaggtcaccaagcccaagaagg

SEQ ID NO: 118080 - DNA, 25 bp, mus musculus
ggtcaccaagcccaagaaggtcaag

SEQ ID NO: 118081 - DNA, 25 bp, mus musculus
gtcaccaagcccaagaaggtcaaga

SEQ ID NO: 118082 - DNA, 25 bp, mus musculus
tcaccaagcccaagaaggtcaagag

SEQ ID NO: 118083 - DNA, 25 bp, mus musculus
caccaagcccaagaaggtcaagagc

SEQ ID NO: 118084 - DNA, 25 bp, mus musculus
accaagcccaagaaggtcaagagcg

SEQ ID NO: 118085 - DNA, 25 bp, mus musculus
tctaaagccgtaaagccaaaggctg

SEQ ID NO: 118086 - DNA, 25 bp, mus musculus
agccgtaaagccaaaggctgccaag

SEQ ID NO: 118087 - DNA, 25 bp, mus musculus
gattacattagctatgtctggcaga

SEQ ID NO: 118088 - DNA, 25 bp, mus musculus
attacattagctatgtctggcagag

SEQ ID NO: 118089 - DNA, 25 bp, mus musculus
gcgccatcgcaaagtcttgcgtgac

SEQ ID NO: 118090 - DNA, 25 bp, mus musculus
ccatcgcaaagtcttgcgtgacaac

SEQ ID NO: 118091 - DNA, 25 bp, mus musculus
catcgcaaagtcttgcgtgacaaca

SEQ ID NO: 118092 - DNA, 25 bp, mus musculus
caaagtcttgcgtgacaacatccag

SEQ ID NO: 118093 - DNA, 25 bp, mus musculus
aaagtcttgcgtgacaacatccagg

SEQ ID NO: 118094 - DNA, 25 bp, mus musculus
gtcttgcgtgacaacatccagggta

SEQ ID NO: 118095 - DNA, 25 bp, mus musculus
cttgcgtgacaacatccagggtatc

SEQ ID NO: 118096 - DNA, 25 bp, mus musculus
cctctacggcttcggaggctagacg

SEQ ID NO: 118097 - DNA, 25 bp, mus musculus
ctacggcttcggaggctagacgccg

SEQ ID NO: 118098 - DNA, 25 bp, mus musculus
tacggcttcggaggctagacgccgc

SEQ ID NO: 118099 - DNA, 25 bp, mus musculus
tacattagctatgtctggcagagga

SEQ ID NO: 118100 - DNA, 25 bp, mus musculus
attagctatgtctggcagaggaaag

SEQ ID NO: 118101 - DNA, 25 bp, mus musculus
ttagctatgtctggcagaggaaagg

SEQ ID NO: 118102 - DNA, 25 bp, mus musculus
ggcgccaagcgccatcgcaaagtct

SEQ ID NO: 118103 - DNA, 25 bp, mus musculus
cgccaagcgccatcgcaaagtcttg

SEQ ID NO: 118104 - DNA, 25 bp, mus musculus
gccaagcgccatcgcaaagtcttgc

SEQ ID NO: 118105 - DNA, 25 bp, mus musculus
caagcgccatcgcaaagtcttgcgt

SEQ ID NO: 118106 - DNA, 25 bp, mus musculus
aagcgccatcgcaaagtcttgcgtg

SEQ ID NO: 118107 - DNA, 25 bp, mus musculus
tcccaggtctaggcgcttccagtgg

SEQ ID NO: 118108 - DNA, 25 bp, mus musculus
ccaggtctaggcgcttccagtggct

SEQ ID NO: 118109 - DNA, 25 bp, mus musculus
ttgcacaagtgacttctgggcccag

SEQ ID NO: 118110 - DNA, 25 bp, mus musculus
acaagtgacttctgggcccagttct

SEQ ID NO: 118111 - DNA, 25 bp, mus musculus
aagtgacttctgggcccagttctgg

SEQ ID NO: 118112 - DNA, 25 bp, mus musculus
gacttctgggcccagttctggggca

SEQ ID NO: 118113 - DNA, 25 bp, mus musculus
tgggcccagttctggggcaaagatg

SEQ ID NO: 118114 - DNA, 25 bp, mus musculus
ggcccagttctggggcaaagatgcc

SEQ ID NO: 118115 - DNA, 25 bp, mus musculus
cccagttctggggcaaagatgcctg

SEQ ID NO: 118116 - DNA, 25 bp, mus musculus
gcaaagatgcctgcccttcacatcg

SEQ ID NO: 118117 - DNA, 25 bp, mus musculus
tgagcaacttcgcaaagaagtcaag

SEQ ID NO: 118118 - DNA, 25 bp, mus musculus
agcaacttcgcaaagaagtcaagtt

SEQ ID NO: 118119 - DNA, 25 bp, mus musculus
aggcgcttccagtggctcccttgca

SEQ ID NO: 118120 - DNA, 25 bp, mus musculus
gcgcttccagtggctcccttgcaca

SEQ ID NO: 118121 - DNA, 25 bp, mus musculus
gcttccagtggctcccttgcacaag

SEQ ID NO: 118122 - DNA, 25 bp, mus musculus
ttccagtggctcccttgcacaagtg

SEQ ID NO: 118123 - DNA, 25 bp, mus musculus
agtggctcccttgcacaagtgactt

SEQ ID NO: 118124 - DNA, 25 bp, mus musculus
tggctcccttgcacaagtgacttct

SEQ ID NO: 118125 - DNA, 25 bp, mus musculus
gctcccttgcacaagtgacttctgg

SEQ ID NO: 118126 - DNA, 25 bp, mus musculus
tcccttgcacaagtgacttctgggc

SEQ ID NO: 118127 - DNA, 25 bp, mus musculus
cctctactgcacatgcgcacattgg

SEQ ID NO: 118128 - DNA, 25 bp, mus musculus
atgcgcacattggttgtttacccat

SEQ ID NO: 118129 - DNA, 25 bp, mus musculus
atatgcacttttcaccattgccaat

SEQ ID NO: 118130 - DNA, 25 bp, mus musculus
acttttcaccattgccaattgcttg

SEQ ID NO: 118131 - DNA, 25 bp, mus musculus
caccattgccaattgcttgcatctc

SEQ ID NO: 118132 - DNA, 25 bp, mus musculus
gcatctccctcagtttctatactgt

SEQ ID NO: 118133 - DNA, 25 bp, mus musculus
ccctcagtttctatactgttacgct

SEQ ID NO: 118134 - DNA, 25 bp, mus musculus
taagtcccaggccttgtgaggtgga

SEQ ID NO: 118135 - DNA, 25 bp, mus musculus
agggcccatcagtttaatgccactt

SEQ ID NO: 118136 - DNA, 25 bp, mus musculus
catcagtttaatgccactttcaact

SEQ ID NO: 118137 - DNA, 25 bp, mus musculus
tttaatgccactttcaactgtagaa

SEQ ID NO: 118138 - DNA, 25 bp, mus musculus
attatcaggcactatgcaatgcaat

SEQ ID NO: 118139 - DNA, 25 bp, mus musculus
gttgtttacccatattcatgggcgt

SEQ ID NO: 118140 - DNA, 25 bp, mus musculus
tacccatattcatgggcgtcagctt

SEQ ID NO: 118141 - DNA, 25 bp, mus musculus
tcagcttattgaaaccagtgccatc

SEQ ID NO: 118142 - DNA, 25 bp, mus musculus
tattgaaaccagtgccatcttgtaa

SEQ ID NO: 118143 - DNA, 25 bp, mus musculus
aaccagtgccatcttgtaatggcgt

SEQ ID NO: 118144 - DNA, 25 bp, mus musculus
tttattggcttcccatactccctag

SEQ ID NO: 118145 - DNA, 25 bp, mus musculus
ggcttcccatactccctagcacagg

SEQ ID NO: 118146 - DNA, 25 bp, mus musculus
actgtaaaggcccataggtatggag

SEQ ID NO: 118147 - DNA, 25 bp, mus musculus
agacagctccgacgcagactacgga

SEQ ID NO: 118148 - DNA, 25 bp, mus musculus
acagctccgacgcagactacggacc

SEQ ID NO: 118149 - DNA, 25 bp, mus musculus
tccggaaacactagccggggatcat

SEQ ID NO: 118150 - DNA, 25 bp, mus musculus
cggaaacactagccggggatcatga

SEQ ID NO: 118151 - DNA, 25 bp, mus musculus
gaaacactagccggggatcatgagt

SEQ ID NO: 118152 - DNA, 25 bp, mus musculus
aacactagccggggatcatgagtgg

SEQ ID NO: 118153 - DNA, 25 bp, mus musculus
cactagccggggatcatgagtggct

SEQ ID NO: 118154 - DNA, 25 bp, mus musculus
atcatgagtggctgtcgagtgttca

SEQ ID NO: 118155 - DNA, 25 bp, mus musculus
gctgtcgagtgttcattgggagact

SEQ ID NO: 118156 - DNA, 25 bp, mus musculus
tgtcgagtgttcattgggagactaa

SEQ ID NO: 118157 - DNA, 25 bp, mus musculus
tcttcaagggttacggacggatcag

SEQ ID NO: 118158 - DNA, 25 bp, mus musculus
tttgaggacccaagggatgcagatg

SEQ ID NO: 118159 - DNA, 25 bp, mus musculus
agctccgacgcagactacggacctc

SEQ ID NO: 118160 - DNA, 25 bp, mus musculus
acggacctctccaggtctcagccgt

SEQ ID NO: 118161 - DNA, 25 bp, mus musculus
ggacctctccaggtctcagccgtca

SEQ ID NO: 118162 - DNA, 25 bp, mus musculus
ctctccaggtctcagccgtcaaaga

SEQ ID NO: 118163 - DNA, 25 bp, mus musculus
ctccaggtctcagccgtcaaagacc

SEQ ID NO: 118164 - DNA, 25 bp, mus musculus
ccaggtctcagccgtcaaagaccct

SEQ ID NO: 118165 - DNA, 25 bp, mus musculus
aggtctcagccgtcaaagaccctgt

SEQ ID NO: 118166 - DNA, 25 bp, mus musculus
gtctcagccgtcaaagaccctgtcc

SEQ ID NO: 118167 - DNA, 25 bp, mus musculus
acttgtgatctccaaggacaagagg

SEQ ID NO: 118168 - DNA, 25 bp, mus musculus
tgtgatctccaaggacaagaggagc

SEQ ID NO: 118169 - DNA, 25 bp, mus musculus
tggtcagcagctgggcaacgtcact

SEQ ID NO: 118170 - DNA, 25 bp, mus musculus
tcagcagctgggcaacgtcactctg

SEQ ID NO: 118171 - DNA, 25 bp, mus musculus
ttttccgagaatggggtgtcgagag

SEQ ID NO: 118172 - DNA, 25 bp, mus musculus
ctgcgcactctgccaaggcagcata

SEQ ID NO: 118173 - DNA, 25 bp, mus musculus
actctgccaaggcagcataagagct

SEQ ID NO: 118174 - DNA, 25 bp, mus musculus
ctgccaaggcagcataagagctgtt

SEQ ID NO: 118175 - DNA, 25 bp, mus musculus
tctggtttccttggagaaaagctct

SEQ ID NO: 118176 - DNA, 25 bp, mus musculus
ctctgctgccctgattatgaactct

SEQ ID NO: 118177 - DNA, 25 bp, mus musculus
tgctgccctgattatgaactctata

SEQ ID NO: 118178 - DNA, 25 bp, mus musculus
ctttctgtaatcatgtgatgtatat

SEQ ID NO: 118179 - DNA, 25 bp, mus musculus
actctgggactctgggaccctctct

SEQ ID NO: 118180 - DNA, 25 bp, mus musculus
aagcctgagggcatggatgagcttc

SEQ ID NO: 118181 - DNA, 25 bp, mus musculus
ttaccctgaactcaacgcctcgagg

SEQ ID NO: 118182 - DNA, 25 bp, mus musculus
ccctgaactcaacgcctcgaggctg

SEQ ID NO: 118183 - DNA, 25 bp, mus musculus
actcaacgcctcgaggctggacctg

SEQ ID NO: 118184 - DNA, 25 bp, mus musculus
agagctagcacacgctggtcagcag

SEQ ID NO: 118185 - DNA, 25 bp, mus musculus
gctagcacacgctggtcagcagctg

SEQ ID NO: 118186 - DNA, 25 bp, mus musculus
cgctggtcagcagctgggcaacgtc

SEQ ID NO: 118187 - DNA, 25 bp, mus musculus
cttgatggcagccttggcagcagga

SEQ ID NO: 118188 - DNA, 25 bp, mus musculus
cttggcagcaggacatcttgtcaga

SEQ ID NO: 118189 - DNA, 25 bp, mus musculus
tctttgcacagagactcctcagatg

SEQ ID NO: 118190 - DNA, 25 bp, mus musculus
gactcctcagatgtggaaactctgg

SEQ ID NO: 118191 - DNA, 25 bp, mus musculus
actctggttctttccgtgctgtgtt

SEQ ID NO: 118192 - DNA, 25 bp, mus musculus
tccgtgctgtgttctggaaagatct

SEQ ID NO: 118193 - DNA, 25 bp, mus musculus
aagatctcacgtggatggtaccggt

SEQ ID NO: 118194 - DNA, 25 bp, mus musculus
taccggtgctctgagcaccacagat

SEQ ID NO: 118195 - DNA, 25 bp, mus musculus
tgctctgagcaccacagatgtgagc

SEQ ID NO: 118196 - DNA, 25 bp, mus musculus
gagcaccacagatgtgagctacagt

SEQ ID NO: 118197 - DNA, 25 bp, mus musculus
ttcgtttctgaaagctaccacaagc

SEQ ID NO: 118198 - DNA, 25 bp, mus musculus
tctgaaagctaccacaagctggaaa

SEQ ID NO: 118199 - DNA, 25 bp, mus musculus
acatcttgtcagaagtcacatggtt

SEQ ID NO: 118200 - DNA, 25 bp, mus musculus
ttgaggatcctgacactgaactgaa

SEQ ID NO: 118201 - DNA, 25 bp, mus musculus
atcctgacactgaactgaagcgcgg

SEQ ID NO: 118202 - DNA, 25 bp, mus musculus
acactgaactgaagcgcgggcattg

SEQ ID NO: 118203 - DNA, 25 bp, mus musculus
aaatctcaatgcactgtctagtgga

SEQ ID NO: 118204 - DNA, 25 bp, mus musculus
cagtgacacccctgcttggtttctg

SEQ ID NO: 118205 - DNA, 25 bp, mus musculus
tgcttggtttctggcgctttcagag

SEQ ID NO: 118206 - DNA, 25 bp, mus musculus
gtttctggcgctttcagagacgtct

SEQ ID NO: 118207 - DNA, 25 bp, mus musculus
ctcacctgagactagacagatgggg

SEQ ID NO: 118208 - DNA, 25 bp, mus musculus
gcccatctccagagtaagggcctgt

SEQ ID NO: 118209 - DNA, 25 bp, mus musculus
atacccactattgctgctgctacca

SEQ ID NO: 118210 - DNA, 25 bp, mus musculus
gctgctgctaccagcgtcagatgtt

SEQ ID NO: 118211 - DNA, 25 bp, mus musculus
gctaccagcgtcagatgttcatcct

SEQ ID NO: 118212 - DNA, 25 bp, mus musculus
accagcgtcagatgttcatcctcct

SEQ ID NO: 118213 - DNA, 25 bp, mus musculus
agatgttcatcctcctgaatttgcc

SEQ ID NO: 118214 - DNA, 25 bp, mus musculus
tgttcatcctcctgaatttgcctgt

SEQ ID NO: 118215 - DNA, 25 bp, mus musculus
tcatcctcctgaatttgcctgtatt

SEQ ID NO: 118216 - DNA, 25 bp, mus musculus
tcctgaatttgcctgtattctctcc

SEQ ID NO: 118217 - DNA, 25 bp, mus musculus
cccgtggatgctgcagcagagtgag

SEQ ID NO: 118218 - DNA, 25 bp, mus musculus
tggccagtatttgtcccagcctggg

SEQ ID NO: 118219 - DNA, 25 bp, mus musculus
cccagtccactctaggctgttcctt

SEQ ID NO: 118220 - DNA, 25 bp, mus musculus
tcctccgcagggcactaaggagcta

SEQ ID NO: 118221 - DNA, 25 bp, mus musculus
ccccatggttctggttccatcttct

SEQ ID NO: 118222 - DNA, 25 bp, mus musculus
catggttctggttccatcttctcct

SEQ ID NO: 118223 - DNA, 25 bp, mus musculus
tctgttcacaaactacctctggacg

SEQ ID NO: 118224 - DNA, 25 bp, mus musculus
ttccatgttcattcttagataccca

SEQ ID NO: 118225 - DNA, 25 bp, mus musculus
gttcattcttagatacccactattg

SEQ ID NO: 118226 - DNA, 25 bp, mus musculus
tagatacccactattgctgctgcta

SEQ ID NO: 118227 - DNA, 25 bp, mus musculus
tgtagactctctggtcattgaacac

SEQ ID NO: 118228 - DNA, 25 bp, mus musculus
gtagactctctggtcattgaacaca

SEQ ID NO: 118229 - DNA, 25 bp, mus musculus
tgaacacatccaggtgaacaaggct

SEQ ID NO: 118230 - DNA, 25 bp, mus musculus
gaacacatccaggtgaacaaggctc

SEQ ID NO: 118231 - DNA, 25 bp, mus musculus
cacatccaggtgaacaaggctccta

SEQ ID NO: 118232 - DNA, 25 bp, mus musculus
gaacaaggctcctaagatgcgcaga

SEQ ID NO: 118233 - DNA, 25 bp, mus musculus
caaggctcctaagatgcgcagacga

SEQ ID NO: 118234 - DNA, 25 bp, mus musculus
aaggctcctaagatgcgcagacgaa

SEQ ID NO: 118235 - DNA, 25 bp, mus musculus
ggctcctaagatgcgcagacgaacc

SEQ ID NO: 118236 - DNA, 25 bp, mus musculus
gctcctaagatgcgcagacgaacct

SEQ ID NO: 118237 - DNA, 25 bp, mus musculus
tcctaagatgcgcagacgaacctac

SEQ ID NO: 118238 - DNA, 25 bp, mus musculus
gcgcagacgaacctacagagctcac

SEQ ID NO: 118239 - DNA, 25 bp, mus musculus
agactctctggtcattgaacacatc

SEQ ID NO: 118240 - DNA, 25 bp, mus musculus
gactctctggtcattgaacacatcc

SEQ ID NO: 118241 - DNA, 25 bp, mus musculus
ctctctggtcattgaacacatccag

SEQ ID NO: 118242 - DNA, 25 bp, mus musculus
tctctggtcattgaacacatccagg

SEQ ID NO: 118243 - DNA, 25 bp, mus musculus
ggtcattgaacacatccaggtgaac

SEQ ID NO: 118244 - DNA, 25 bp, mus musculus
gtcattgaacacatccaggtgaaca

SEQ ID NO: 118245 - DNA, 25 bp, mus musculus
cattgaacacatccaggtgaacaag

SEQ ID NO: 118246 - DNA, 25 bp, mus musculus
attgaacacatccaggtgaacaagg

SEQ ID NO: 118247 - DNA, 25 bp, mus musculus
agccttcatggacaagtacatgaaa

SEQ ID NO: 118248 - DNA, 25 bp, mus musculus
catgaaagctattccaactaaggtt

SEQ ID NO: 118249 - DNA, 25 bp, mus musculus
ggtattatcctgctggcggtacgtg

SEQ ID NO: 118250 - DNA, 25 bp, mus musculus
atcctgctggcggtacgtgtcttct

SEQ ID NO: 118251 - DNA, 25 bp, mus musculus
cctgctggcggtacgtgtcttctgc

SEQ ID NO: 118252 - DNA, 25 bp, mus musculus
cggtacgtgtcttctgccatgccta

SEQ ID NO: 118253 - DNA, 25 bp, mus musculus
gtacgtgtcttctgccatgcctatt

SEQ ID NO: 118254 - DNA, 25 bp, mus musculus
acgtgtcttctgccatgcctatttt

SEQ ID NO: 118255 - DNA, 25 bp, mus musculus
gtgtcttctgccatgcctattttgc

SEQ ID NO: 118256 - DNA, 25 bp, mus musculus
cttctgccatgcctattttgcctga

SEQ ID NO: 118257 - DNA, 25 bp, mus musculus
tctgccatgcctattttgcctgagc

SEQ ID NO: 118258 - DNA, 25 bp, mus musculus
ccatgcctattttgcctgagccctg

SEQ ID NO: 118259 - DNA, 25 bp, mus musculus
ttaccgccaaggaagatgaagatga

SEQ ID NO: 118260 - DNA, 25 bp, mus musculus
gcctattttgcctgagccctgcctt

SEQ ID NO: 118261 - DNA, 25 bp, mus musculus
aagatgacagacacttctgagaagc

SEQ ID NO: 118262 - DNA, 25 bp, mus musculus
gatgacagacacttctgagaagcct

SEQ ID NO: 118263 - DNA, 25 bp, mus musculus
tgacagacacttctgagaagccttt

SEQ ID NO: 118264 - DNA, 25 bp, mus musculus
acacttctgagaagcctttgtggag

SEQ ID NO: 118265 - DNA, 25 bp, mus musculus
ctgagaagcctttgtggaggacagt

SEQ ID NO: 118266 - DNA, 25 bp, mus musculus
acatcaacggtattatcctgctggc

SEQ ID NO: 118267 - DNA, 25 bp, mus musculus
acggtattatcctgctggcggtacg

SEQ ID NO: 118268 - DNA, 25 bp, mus musculus
tgttactgcaagaaacccacctggt

SEQ ID NO: 118269 - DNA, 25 bp, mus musculus
tgcaagaaacccacctggtactcca

SEQ ID NO: 118270 - DNA, 25 bp, mus musculus
gtaactgcacaggaggcaaaccagg

SEQ ID NO: 118271 - DNA, 25 bp, mus musculus
ctacacagagactcttctagacaat

SEQ ID NO: 118272 - DNA, 25 bp, mus musculus
agagactcttctagacaataagaca

SEQ ID NO: 118273 - DNA, 25 bp, mus musculus
gatcagcactgaccagggcagagct

SEQ ID NO: 118274 - DNA, 25 bp, mus musculus
gccttgtacccaagcctgcatgcag

SEQ ID NO: 118275 - DNA, 25 bp, mus musculus
tacccaagcctgcatgcagcctagc

SEQ ID NO: 118276 - DNA, 25 bp, mus musculus
agcctgcatgcagcctagcactaag

SEQ ID NO: 118277 - DNA, 25 bp, mus musculus
ctctggcacctgactgtcagtgact

SEQ ID NO: 118278 - DNA, 25 bp, mus musculus
agtgactgacttacctgtggtatta

SEQ ID NO: 118279 - DNA, 25 bp, mus musculus
tgacttacctgtggtattaacaagt

SEQ ID NO: 118280 - DNA, 25 bp, mus musculus
tactccaagtgtgctaccattcctg

SEQ ID NO: 118281 - DNA, 25 bp, mus musculus
gctaccattcctggagtcctgaagc

SEQ ID NO: 118282 - DNA, 25 bp, mus musculus
taagatgcccccttaacattcggca

SEQ ID NO: 118283 - DNA, 25 bp, mus musculus
gcccccttaacattcggcacagagg

SEQ ID NO: 118284 - DNA, 25 bp, mus musculus
gctcagtggcccaatatctgcgtgg

SEQ ID NO: 118285 - DNA, 25 bp, mus musculus
aatatctgcgtggtaagtgggatgc

SEQ ID NO: 118286 - DNA, 25 bp, mus musculus
tttgattccccagcactgacggtcg

SEQ ID NO: 118287 - DNA, 25 bp, mus musculus
gcactgacggtcgttggtgtaactg

SEQ ID NO: 118288 - DNA, 25 bp, mus musculus
gcgcactgagctgcagctgctcaac

SEQ ID NO: 118289 - DNA, 25 bp, mus musculus
cactgagctgcagctgctcaaccag

SEQ ID NO: 118290 - DNA, 25 bp, mus musculus
cactcgggagcagctggccaggaag

SEQ ID NO: 118291 - DNA, 25 bp, mus musculus
gaaccgccgagccaagtggagacga

SEQ ID NO: 118292 - DNA, 25 bp, mus musculus
acgacagaagcgatcctcctcggag

SEQ ID NO: 118293 - DNA, 25 bp, mus musculus
caagacgtcctcaaaagcctcgccg

SEQ ID NO: 118294 - DNA, 25 bp, mus musculus
cgatttggactcggacagctgacgg

SEQ ID NO: 118295 - DNA, 25 bp, mus musculus
cgcttgcctgacgcaaggacttgca

SEQ ID NO: 118296 - DNA, 25 bp, mus musculus
acttgcacagacagtcgatgctact

SEQ ID NO: 118297 - DNA, 25 bp, mus musculus
acagacagtcgatgctacttgcaca

SEQ ID NO: 118298 - DNA, 25 bp, mus musculus
aatgtacaggcccaggactgctggg

SEQ ID NO: 118299 - DNA, 25 bp, mus musculus
gtacaggcccaggactgctggggac

SEQ ID NO: 118300 - DNA, 25 bp, mus musculus
gcagctgctcaaccagctgcactgt

SEQ ID NO: 118301 - DNA, 25 bp, mus musculus
gctgctcaaccagctgcactgtcgg

SEQ ID NO: 118302 - DNA, 25 bp, mus musculus
caccatcttcaccgatgagcagctc

SEQ ID NO: 118303 - DNA, 25 bp, mus musculus
catcttcaccgatgagcagctcgaa

SEQ ID NO: 118304 - DNA, 25 bp, mus musculus
cttcaccgatgagcagctcgaagcc

SEQ ID NO: 118305 - DNA, 25 bp, mus musculus
gcagctcgaagccctggagaacctc

SEQ ID NO: 118306 - DNA, 25 bp, mus musculus
gacgaagtacccagacgtgggcact

SEQ ID NO: 118307 - DNA, 25 bp, mus musculus
cccagacgtgggcactcgggagcag

SEQ ID NO: 118308 - DNA, 25 bp, mus musculus
aaccagctctgctggaactggaagg

SEQ ID NO: 118309 - DNA, 25 bp, mus musculus
ttgatgacactgagctgaagcaggt

SEQ ID NO: 118310 - DNA, 25 bp, mus musculus
ggcaaaattaactccattacagtag

SEQ ID NO: 118311 - DNA, 25 bp, mus musculus
agaactccctggactgtgagatagt

SEQ ID NO: 118312 - DNA, 25 bp, mus musculus
agaagttggtcaccacagtgacaga

SEQ ID NO: 118313 - DNA, 25 bp, mus musculus
aagttggtcaccacagtgacagaaa

SEQ ID NO: 118314 - DNA, 25 bp, mus musculus
gttggtcaccacagtgacagaaatc

SEQ ID NO: 118315 - DNA, 25 bp, mus musculus
gcaaatacatgggtcctgtgccctc

SEQ ID NO: 118316 - DNA, 25 bp, mus musculus
ctcccttcacaccatgggatacatc

SEQ ID NO: 118317 - DNA, 25 bp, mus musculus
tcacaccatgggatacatctgtatg

SEQ ID NO: 118318 - DNA, 25 bp, mus musculus
acaccatgggatacatctgtatgga

SEQ ID NO: 118319 - DNA, 25 bp, mus musculus
atacatctgtatggagacggttctt

SEQ ID NO: 118320 - DNA, 25 bp, mus musculus
tgacactgagctgaagcaggtggct

SEQ ID NO: 118321 - DNA, 25 bp, mus musculus
acactgagctgaagcaggtggctta

SEQ ID NO: 118322 - DNA, 25 bp, mus musculus
ttacatctacaagtgtgtcaacaca

SEQ ID NO: 118323 - DNA, 25 bp, mus musculus
acatctacaagtgtgtcaacacaac

SEQ ID NO: 118324 - DNA, 25 bp, mus musculus
gtgtgtcaacacaacattgcaaatc

SEQ ID NO: 118325 - DNA, 25 bp, mus musculus
gtcaacacaacattgcaaatcaagg

SEQ ID NO: 118326 - DNA, 25 bp, mus musculus
caacacaacattgcaaatcaagggc

SEQ ID NO: 118327 - DNA, 25 bp, mus musculus
acacaacattgcaaatcaagggcaa

SEQ ID NO: 118328 - DNA, 25 bp, mus musculus
tttctccacagattcctgcctgcag

SEQ ID NO: 118329 - DNA, 25 bp, mus musculus
cacagattcctgcctgcagctttca

SEQ ID NO: 118330 - DNA, 25 bp, mus musculus
ttgaccaggtggctttgccttcttt

SEQ ID NO: 118331 - DNA, 25 bp, mus musculus
tcttcttgatctacccctactctct

SEQ ID NO: 118332 - DNA, 25 bp, mus musculus
actctctcaaatgttgaggactttc

SEQ ID NO: 118333 - DNA, 25 bp, mus musculus
agttttaaagccatctcttgcaaat

SEQ ID NO: 118334 - DNA, 25 bp, mus musculus
atctcttgcaaattatgttggcgtt

SEQ ID NO: 118335 - DNA, 25 bp, mus musculus
ttacacagaacccaacaagcttcta

SEQ ID NO: 118336 - DNA, 25 bp, mus musculus
agaacccaacaagcttctatgtgat

SEQ ID NO: 118337 - DNA, 25 bp, mus musculus
caacaagcttctatgtgattttcct

SEQ ID NO: 118338 - DNA, 25 bp, mus musculus
ttgtaccacattagaatgcattgtc

SEQ ID NO: 118339 - DNA, 25 bp, mus musculus
cattgtcatgcgtatttttggtaga

SEQ ID NO: 118340 - DNA, 25 bp, mus musculus
gctttcagatgcactgtcgcccagc

SEQ ID NO: 118341 - DNA, 25 bp, mus musculus
agatgcactgtcgcccagcttgcct

SEQ ID NO: 118342 - DNA, 25 bp, mus musculus
tggctccctggacagtcctgtagat

SEQ ID NO: 118343 - DNA, 25 bp, mus musculus
cctggacagtcctgtagatatctca

SEQ ID NO: 118344 - DNA, 25 bp, mus musculus
cagctttgacttttttacagacaca

SEQ ID NO: 118345 - DNA, 25 bp, mus musculus
ttttacagacacactcaccacaatc

SEQ ID NO: 118346 - DNA, 25 bp, mus musculus
actcaccacaatcgacctacagcat

SEQ ID NO: 118347 - DNA, 25 bp, mus musculus
acagcatctgaattactaagaacat

SEQ ID NO: 118348 - DNA, 25 bp, mus musculus
ccgcagaccgtgccgacgtgccgag

SEQ ID NO: 118349 - DNA, 25 bp, mus musculus
ttcgggacacctccgctgtcgccaa

SEQ ID NO: 118350 - DNA, 25 bp, mus musculus
ccaaatgccgcaagcgcaactgtga

SEQ ID NO: 118351 - DNA, 25 bp, mus musculus
aatgccgcaagcgcaactgtgagcg

SEQ ID NO: 118352 - DNA, 25 bp, mus musculus
ccgcaagcgcaactgtgagcgtatc

SEQ ID NO: 118353 - DNA, 25 bp, mus musculus
cgcaagcgcaactgtgagcgtatct

SEQ ID NO: 118354 - DNA, 25 bp, mus musculus
gcaagcgcaactgtgagcgtatctc

SEQ ID NO: 118355 - DNA, 25 bp, mus musculus
caagcgcaactgtgagcgtatctcg

SEQ ID NO: 118356 - DNA, 25 bp, mus musculus
aagcgcaactgtgagcgtatctcgc

SEQ ID NO: 118357 - DNA, 25 bp, mus musculus
gcaactgtgagcgtatctcgcgcct

SEQ ID NO: 118358 - DNA, 25 bp, mus musculus
caactgtgagcgtatctcgcgcctg

SEQ ID NO: 118359 - DNA, 25 bp, mus musculus
ctgcgcgacaggtaggcgcacgtca

SEQ ID NO: 118360 - DNA, 25 bp, mus musculus
caagaacgcatcaaggcggacgcga

SEQ ID NO: 118361 - DNA, 25 bp, mus musculus
gaacgcatcaaggcggacgcgaaga

SEQ ID NO: 118362 - DNA, 25 bp, mus musculus
aacgcatcaaggcggacgcgaagag

SEQ ID NO: 118363 - DNA, 25 bp, mus musculus
acgcatcaaggcggacgcgaagagg

SEQ ID NO: 118364 - DNA, 25 bp, mus musculus
gcatcaaggcggacgcgaagaggct

SEQ ID NO: 118365 - DNA, 25 bp, mus musculus
catcaaggcggacgcgaagaggctg

SEQ ID NO: 118366 - DNA, 25 bp, mus musculus
atcaaggcggacgcgaagaggctgc

SEQ ID NO: 118367 - DNA, 25 bp, mus musculus
tccaaatgccgcaagcgcaactgtg

SEQ ID NO: 118368 - DNA, 25 bp, mus musculus
gcgtcgtcaacatcactggcaggca

SEQ ID NO: 118369 - DNA, 25 bp, mus musculus
tcaacatcactggcaggcacgatga

SEQ ID NO: 118370 - DNA, 25 bp, mus musculus
ctatctcctgagggtacacttactc

SEQ ID NO: 118371 - DNA, 25 bp, mus musculus
tctcctgagggtacacttactcgtg

SEQ ID NO: 118372 - DNA, 25 bp, mus musculus
ggtacacttactcgtggaggcatcc

SEQ ID NO: 118373 - DNA, 25 bp, mus musculus
acacttactcgtggaggcatccggt

SEQ ID NO: 118374 - DNA, 25 bp, mus musculus
ggcatccggttgccgaagcagtcac

SEQ ID NO: 118375 - DNA, 25 bp, mus musculus
cggttgccgaagcagtcacgcattc

SEQ ID NO: 118376 - DNA, 25 bp, mus musculus
ttgccgaagcagtcacgcattcagc

SEQ ID NO: 118377 - DNA, 25 bp, mus musculus
cggagatcaccattccaggttacta

SEQ ID NO: 118378 - DNA, 25 bp, mus musculus
agatcaccattccaggttactatta

SEQ ID NO: 118379 - DNA, 25 bp, mus musculus
ttccaggttactattagaggccgcg

SEQ ID NO: 118380 - DNA, 25 bp, mus musculus
aacatggctacatctctctggtgct

SEQ ID NO: 118381 - DNA, 25 bp, mus musculus
atggctacatctctctggtgcttca

SEQ ID NO: 118382 - DNA, 25 bp, mus musculus
gctacatctctctggtgcttcaccc

SEQ ID NO: 118383 - DNA, 25 bp, mus musculus
tctctctggtgcttcacccgggata

SEQ ID NO: 118384 - DNA, 25 bp, mus musculus
cacgcatcctccagtgtgtggagcc

SEQ ID NO: 118385 - DNA, 25 bp, mus musculus
gcatcctccagtgtgtggagcctat

SEQ ID NO: 118386 - DNA, 25 bp, mus musculus
ctatccctagtgtcctcatccctat

SEQ ID NO: 118387 - DNA, 25 bp, mus musculus
tcatccctatctcctgagggtacac

SEQ ID NO: 118388 - DNA, 25 bp, mus musculus
cctcgcttattcgcacctcatttct

SEQ ID NO: 118389 - DNA, 25 bp, mus musculus
ctcgcttattcgcacctcatttctg

SEQ ID NO: 118390 - DNA, 25 bp, mus musculus
catttctgcccacaggtgccgtgta

SEQ ID NO: 118391 - DNA, 25 bp, mus musculus
cccacaggtgccgtgtatgggagtc

SEQ ID NO: 118392 - DNA, 25 bp, mus musculus
cacaggtgccgtgtatgggagtcac

SEQ ID NO: 118393 - DNA, 25 bp, mus musculus
acaggtgccgtgtatgggagtcacg

SEQ ID NO: 118394 - DNA, 25 bp, mus musculus
taaactcatcaactccacgcaggcc

SEQ ID NO: 118395 - DNA, 25 bp, mus musculus
tccacgcaggccagcggggaagact

SEQ ID NO: 118396 - DNA, 25 bp, mus musculus
ccacgcaggccagcggggaagactc

SEQ ID NO: 118397 - DNA, 25 bp, mus musculus
acgcaggccagcggggaagactctg

SEQ ID NO: 118398 - DNA, 25 bp, mus musculus
cgcaggccagcggggaagactctga

SEQ ID NO: 118399 - DNA, 25 bp, mus musculus
gactctgaggccaaagcgggcgagt

SEQ ID NO: 118400 - DNA, 25 bp, mus musculus
tcgcttattcgcacctcatttctgc

SEQ ID NO: 118401 - DNA, 25 bp, mus musculus
ctctgaggccaaagcgggcgagtag

SEQ ID NO: 118402 - DNA, 25 bp, mus musculus
gcttattcgcacctcatttctgccc

SEQ ID NO: 118403 - DNA, 25 bp, mus musculus
cttattcgcacctcatttctgccca

SEQ ID NO: 118404 - DNA, 25 bp, mus musculus
attcgcacctcatttctgcccacag

SEQ ID NO: 118405 - DNA, 25 bp, mus musculus
ttcgcacctcatttctgcccacagg

SEQ ID NO: 118406 - DNA, 25 bp, mus musculus
tcgcacctcatttctgcccacaggt

SEQ ID NO: 118407 - DNA, 25 bp, mus musculus
acctcatttctgcccacaggtgccg

SEQ ID NO: 118408 - DNA, 25 bp, mus musculus
tcatttctgcccacaggtgccgtgt

SEQ ID NO: 118409 - DNA, 25 bp, mus musculus
tccatgctgggagactgcacccggt

SEQ ID NO: 118410 - DNA, 25 bp, mus musculus
accggaggatcctctccatggtcca

SEQ ID NO: 118411 - DNA, 25 bp, mus musculus
tccctatggaggtcttcgacccagc

SEQ ID NO: 118412 - DNA, 25 bp, mus musculus
ccagcccacagcgaagtacagcaag

SEQ ID NO: 118413 - DNA, 25 bp, mus musculus
cagcccacagcgaagtacagcaaga

SEQ ID NO: 118414 - DNA, 25 bp, mus musculus
gcccacagcgaagtacagcaagagg

SEQ ID NO: 118415 - DNA, 25 bp, mus musculus
ggagtacgtcctcggatacaacatc

SEQ ID NO: 118416 - DNA, 25 bp, mus musculus
agtacgtcctcggatacaacatcca

SEQ ID NO: 118417 - DNA, 25 bp, mus musculus
gtacgtcctcggatacaacatccaa

SEQ ID NO: 118418 - DNA, 25 bp, mus musculus
tacgtcctcggatacaacatccaaa

SEQ ID NO: 118419 - DNA, 25 bp, mus musculus
gtcctcggatacaacatccaaaaga

SEQ ID NO: 118420 - DNA, 25 bp, mus musculus
tcctcggatacaacatccaaaagat

SEQ ID NO: 118421 - DNA, 25 bp, mus musculus
cggaggatcctctccatggtccaga

SEQ ID NO: 118422 - DNA, 25 bp, mus musculus
aggatcctctccatggtccagaaga

SEQ ID NO: 118423 - DNA, 25 bp, mus musculus
ggatcctctccatggtccagaagag

SEQ ID NO: 118424 - DNA, 25 bp, mus musculus
tcctctccatggtccagaagagcag

SEQ ID NO: 118425 - DNA, 25 bp, mus musculus
cctctccatggtccagaagagcagc

SEQ ID NO: 118426 - DNA, 25 bp, mus musculus
tctccatggtccagaagagcagcat

SEQ ID NO: 118427 - DNA, 25 bp, mus musculus
agaagagcagcatgtcccggggccc

SEQ ID NO: 118428 - DNA, 25 bp, mus musculus
aagagcagcatgtcccggggccctt

SEQ ID NO: 118429 - DNA, 25 bp, mus musculus
atcagcgtctactacaatgagtcat

SEQ ID NO: 118430 - DNA, 25 bp, mus musculus
tcagcgtctactacaatgagtcatc

SEQ ID NO: 118431 - DNA, 25 bp, mus musculus
atgagtcatcctctaagaagtacgt

SEQ ID NO: 118432 - DNA, 25 bp, mus musculus
gagtcatcctctaagaagtacgtac

SEQ ID NO: 118433 - DNA, 25 bp, mus musculus
tcatcctctaagaagtacgtaccca

SEQ ID NO: 118434 - DNA, 25 bp, mus musculus
catcctctaagaagtacgtacccag

SEQ ID NO: 118435 - DNA, 25 bp, mus musculus
ctgccctggtggacttggagcccgg

SEQ ID NO: 118436 - DNA, 25 bp, mus musculus
tgaggtctgggcttttggcaactct

SEQ ID NO: 118437 - DNA, 25 bp, mus musculus
tctgggcttttggcaactcttccgg

SEQ ID NO: 118438 - DNA, 25 bp, mus musculus
ggcttttggcaactcttccggcctg

SEQ ID NO: 118439 - DNA, 25 bp, mus musculus
gcaactcttccggcctgacaacttc

SEQ ID NO: 118440 - DNA, 25 bp, mus musculus
caactcttccggcctgacaacttca

SEQ ID NO: 118441 - DNA, 25 bp, mus musculus
agcgtctactacaatgagtcatcct

SEQ ID NO: 118442 - DNA, 25 bp, mus musculus
gcgtctactacaatgagtcatcctc

SEQ ID NO: 118443 - DNA, 25 bp, mus musculus
tctactacaatgagtcatcctctaa

SEQ ID NO: 118444 - DNA, 25 bp, mus musculus
tactacaatgagtcatcctctaaga

SEQ ID NO: 118445 - DNA, 25 bp, mus musculus
actacaatgagtcatcctctaagaa

SEQ ID NO: 118446 - DNA, 25 bp, mus musculus
tacaatgagtcatcctctaagaagt

SEQ ID NO: 118447 - DNA, 25 bp, mus musculus
acaatgagtcatcctctaagaagta

SEQ ID NO: 118448 - DNA, 25 bp, mus musculus
aatgagtcatcctctaagaagtacg

SEQ ID NO: 118449 - DNA, 25 bp, mus musculus
gaacgacctgtaaccttgcttaatg

SEQ ID NO: 118450 - DNA, 25 bp, mus musculus
cgacctgtaaccttgcttaatgact

SEQ ID NO: 118451 - DNA, 25 bp, mus musculus
ctgccccagcaaagtccagtccaag

SEQ ID NO: 118452 - DNA, 25 bp, mus musculus
cagcaaagtccagtccaaggcaatt

SEQ ID NO: 118453 - DNA, 25 bp, mus musculus
caaagtccagtccaaggcaattgta

SEQ ID NO: 118454 - DNA, 25 bp, mus musculus
agtccagtccaaggcaattgtatta

SEQ ID NO: 118455 - DNA, 25 bp, mus musculus
tatgtttagcaccgtacgtgttcct

SEQ ID NO: 118456 - DNA, 25 bp, mus musculus
tagcaccgtacgtgttcctatctca

SEQ ID NO: 118457 - DNA, 25 bp, mus musculus
tatcctcctgtataaatccgacctc

SEQ ID NO: 118458 - DNA, 25 bp, mus musculus
cctgtataaatccgacctctggatc

SEQ ID NO: 118459 - DNA, 25 bp, mus musculus
taaatccgacctctggatccgttct

SEQ ID NO: 118460 - DNA, 25 bp, mus musculus
cgacctctggatccgttctcgaata

SEQ ID NO: 118461 - DNA, 25 bp, mus musculus
cctgtaaccttgcttaatgactcct

SEQ ID NO: 118462 - DNA, 25 bp, mus musculus
accttgcttaatgactcctcaatga

SEQ ID NO: 118463 - DNA, 25 bp, mus musculus
ttgcttaatgactcctcaatgaacc

SEQ ID NO: 118464 - DNA, 25 bp, mus musculus
cttaatgactcctcaatgaaccgtt

SEQ ID NO: 118465 - DNA, 25 bp, mus musculus
tcctcaatgaaccgttgttcttcct

SEQ ID NO: 118466 - DNA, 25 bp, mus musculus
tcaatgaaccgttgttcttcctaga

SEQ ID NO: 118467 - DNA, 25 bp, mus musculus
tgttcttcctagatgttggaagccc

SEQ ID NO: 118468 - DNA, 25 bp, mus musculus
cctccgggccagagagctggctcca

SEQ ID NO: 118469 - DNA, 25 bp, mus musculus
ctgcagtgacctcgccaaaggcgcc

SEQ ID NO: 118470 - DNA, 25 bp, mus musculus
cagtgacctcgccaaaggcgcctgc

SEQ ID NO: 118471 - DNA, 25 bp, mus musculus
gatgcgcagttcaggacccgacagg

SEQ ID NO: 118472 - DNA, 25 bp, mus musculus
gcgcagttcaggacccgacaggaag

SEQ ID NO: 118473 - DNA, 25 bp, mus musculus
cagttcaggacccgacaggaagcgg

SEQ ID NO: 118474 - DNA, 25 bp, mus musculus
tgcagccccggaagacgcggtgccc

SEQ ID NO: 118475 - DNA, 25 bp, mus musculus
cgtttccacagctgctgacaaggcg

SEQ ID NO: 118476 - DNA, 25 bp, mus musculus
ttccacagctgctgacaaggcggac

SEQ ID NO: 118477 - DNA, 25 bp, mus musculus
cacagctgctgacaaggcggacgag

SEQ ID NO: 118478 - DNA, 25 bp, mus musculus
gcacaggaccctggctgcacaggac

SEQ ID NO: 118479 - DNA, 25 bp, mus musculus
gaccctggctgcacaggacagttgg

SEQ ID NO: 118480 - DNA, 25 bp, mus musculus
cctggctgcacaggacagttggaaa

SEQ ID NO: 118481 - DNA, 25 bp, mus musculus
tgacctcgccaaaggcgcctgcgac

SEQ ID NO: 118482 - DNA, 25 bp, mus musculus
cctcgccaaaggcgcctgcgacaag

SEQ ID NO: 118483 - DNA, 25 bp, mus musculus
cgccaaaggcgcctgcgacaaggcg

SEQ ID NO: 118484 - DNA, 25 bp, mus musculus
caaaggcgcctgcgacaaggcggac

SEQ ID NO: 118485 - DNA, 25 bp, mus musculus
ggccgaagccagtttccgcatctac

SEQ ID NO: 118486 - DNA, 25 bp, mus musculus
agccagtttccgcatctacccctgg

SEQ ID NO: 118487 - DNA, 25 bp, mus musculus
cagtttccgcatctacccctggatg

SEQ ID NO: 118488 - DNA, 25 bp, mus musculus
cccctggatgcgcagttcaggaccc

SEQ ID NO: 118489 - DNA, 25 bp, mus musculus
cctctttagtgccaatgttgtgtgt

SEQ ID NO: 118490 - DNA, 25 bp, mus musculus
ttaatgtgcatgtacgtggaagtgt

SEQ ID NO: 118491 - DNA, 25 bp, mus musculus
caacgtgtagtggctagtggctctg

SEQ ID NO: 118492 - DNA, 25 bp, mus musculus
gctagtggctctgtgacgaaaactg

SEQ ID NO: 118493 - DNA, 25 bp, mus musculus
ggaccctttgcacgaactctggaag

SEQ ID NO: 118494 - DNA, 25 bp, mus musculus
tttgcacgaactctggaagtggctc

SEQ ID NO: 118495 - DNA, 25 bp, mus musculus
actctggaagtggctcttataagcg

SEQ ID NO: 118496 - DNA, 25 bp, mus musculus
gctcttataagcgcagttcagtgat

SEQ ID NO: 118497 - DNA, 25 bp, mus musculus
cttataagcgcagttcagtgatgta

SEQ ID NO: 118498 - DNA, 25 bp, mus musculus
tattgtccaagtctggctgtttaag

SEQ ID NO: 118499 - DNA, 25 bp, mus musculus
tctattgtaagttctcttggtctga

SEQ ID NO: 118500 - DNA, 25 bp, mus musculus
gtaagttctcttggtctgatttatg

SEQ ID NO: 118501 - DNA, 25 bp, mus musculus
gaagtgttcctgtctcaatagctcc

SEQ ID NO: 118502 - DNA, 25 bp, mus musculus
gtgttcctgtctcaatagctccaag

SEQ ID NO: 118503 - DNA, 25 bp, mus musculus
tctcaatagctccaagctgttaaag

SEQ ID NO: 118504 - DNA, 25 bp, mus musculus
caatagctccaagctgttaaagata

SEQ ID NO: 118505 - DNA, 25 bp, mus musculus
tagctccaagctgttaaagatattt

SEQ ID NO: 118506 - DNA, 25 bp, mus musculus
acctatattccttgtgtaattaatg

SEQ ID NO: 118507 - DNA, 25 bp, mus musculus
attaatgctgttgtagaggtgactt

SEQ ID NO: 118508 - DNA, 25 bp, mus musculus
cttgttcaacgtgtagtggctagtg

SEQ ID NO: 118509 - DNA, 25 bp, mus musculus
agctctcatccgccatggagctggc

SEQ ID NO: 118510 - DNA, 25 bp, mus musculus
ccaactttcaatcagacttggattt

SEQ ID NO: 118511 - DNA, 25 bp, mus musculus
tctccatcgatgtgcgagattgtga

SEQ ID NO: 118512 - DNA, 25 bp, mus musculus
ccatcgatgtgcgagattgtgaagg

SEQ ID NO: 118513 - DNA, 25 bp, mus musculus
agacctcagtagtgttcaacaagct

SEQ ID NO: 118514 - DNA, 25 bp, mus musculus
tgggggctaccatacctttgtctgt

SEQ ID NO: 118515 - DNA, 25 bp, mus musculus
gggctaccatacctttgtctgtgga

SEQ ID NO: 118516 - DNA, 25 bp, mus musculus
tacctttgtctgtggatgagggacc

SEQ ID NO: 118517 - DNA, 25 bp, mus musculus
ctttgtctgtggatgagggacctga

SEQ ID NO: 118518 - DNA, 25 bp, mus musculus
ttgacaggcgctgctctcgatgtgg

SEQ ID NO: 118519 - DNA, 25 bp, mus musculus
acaggcgctgctctcgatgtggtca

SEQ ID NO: 118520 - DNA, 25 bp, mus musculus
ggcgctgctctcgatgtggtcacga

SEQ ID NO: 118521 - DNA, 25 bp, mus musculus
cagacttggatttctgcccagattg

SEQ ID NO: 118522 - DNA, 25 bp, mus musculus
gctctcgatgtggtcacgagggaat

SEQ ID NO: 118523 - DNA, 25 bp, mus musculus
tctgcccagattgtggctcagtcct

SEQ ID NO: 118524 - DNA, 25 bp, mus musculus
tgccgctgcctggaattcaggacac

SEQ ID NO: 118525 - DNA, 25 bp, mus musculus
gaattcaggacactgtcatatgttc

SEQ ID NO: 118526 - DNA, 25 bp, mus musculus
ttcaggacactgtcatatgttcgcg

SEQ ID NO: 118527 - DNA, 25 bp, mus musculus
tcatatgttcgcgttgtggcttctc

SEQ ID NO: 118528 - DNA, 25 bp, mus musculus
tatgttcgcgttgtggcttctccat

SEQ ID NO: 118529 - DNA, 25 bp, mus musculus
gtggcttctccatcgatgtgcgaga

SEQ ID NO: 118530 - DNA, 25 bp, mus musculus
cagtgatgtcactactgccaaagac

SEQ ID NO: 118531 - DNA, 25 bp, mus musculus
agtgatgtcactactgccaaagact

SEQ ID NO: 118532 - DNA, 25 bp, mus musculus
cctctgaccccggtgacatcataac

SEQ ID NO: 118533 - DNA, 25 bp, mus musculus
tctgaccccggtgacatcataacct

SEQ ID NO: 118534 - DNA, 25 bp, mus musculus
ctgaccccggtgacatcataacctc

SEQ ID NO: 118535 - DNA, 25 bp, mus musculus
gaccccggtgacatcataacctcca

SEQ ID NO: 118536 - DNA, 25 bp, mus musculus
ccggtgacatcataacctccactca

SEQ ID NO: 118537 - DNA, 25 bp, mus musculus
ggtgacatcataacctccactcaca

SEQ ID NO: 118538 - DNA, 25 bp, mus musculus
gtgacatcataacctccactcacaa

SEQ ID NO: 118539 - DNA, 25 bp, mus musculus
gacatcataacctccactcacaagg

SEQ ID NO: 118540 - DNA, 25 bp, mus musculus
taacctccactcacaaggaggcatc

SEQ ID NO: 118541 - DNA, 25 bp, mus musculus
acctccactcacaaggaggcatcat

SEQ ID NO: 118542 - DNA, 25 bp, mus musculus
tgatgtcactactgccaaagactcc

SEQ ID NO: 118543 - DNA, 25 bp, mus musculus
cctccactcacaaggaggcatcatg

SEQ ID NO: 118544 - DNA, 25 bp, mus musculus
gatgtcactactgccaaagactccg

SEQ ID NO: 118545 - DNA, 25 bp, mus musculus
tgtcactactgccaaagactccgcc

SEQ ID NO: 118546 - DNA, 25 bp, mus musculus
cacaactgacctctgaccccggtga

SEQ ID NO: 118547 - DNA, 25 bp, mus musculus
caactgacctctgaccccggtgaca

SEQ ID NO: 118548 - DNA, 25 bp, mus musculus
aactgacctctgaccccggtgacat

SEQ ID NO: 118549 - DNA, 25 bp, mus musculus
ctgacctctgaccccggtgacatca

SEQ ID NO: 118550 - DNA, 25 bp, mus musculus
acctctgaccccggtgacatcataa

SEQ ID NO: 118551 - DNA, 25 bp, mus musculus
tgtattttgagtttctgctggaaac

SEQ ID NO: 118552 - DNA, 25 bp, mus musculus
agtttctgctggaaacttccataag

SEQ ID NO: 118553 - DNA, 25 bp, mus musculus
aggcccaatgctgtaaatatgggga

SEQ ID NO: 118554 - DNA, 25 bp, mus musculus
atagtctgggtcaggccaatcactt

SEQ ID NO: 118555 - DNA, 25 bp, mus musculus
catttcgcttccaagaccatttgta

SEQ ID NO: 118556 - DNA, 25 bp, mus musculus
ttcgcttccaagaccatttgtagtg

SEQ ID NO: 118557 - DNA, 25 bp, mus musculus
tccaagaccatttgtagtgagcggg

SEQ ID NO: 118558 - DNA, 25 bp, mus musculus
gatgctgtgctacgtgtgaaatctg

SEQ ID NO: 118559 - DNA, 25 bp, mus musculus
gtgaaatctgtctttgccaggcctg

SEQ ID NO: 118560 - DNA, 25 bp, mus musculus
cctgtctcagtgattagcttttggt

SEQ ID NO: 118561 - DNA, 25 bp, mus musculus
attagcttttggtatgtctgtagct

SEQ ID NO: 118562 - DNA, 25 bp, mus musculus
agctttccttgaagttgaataaatg

SEQ ID NO: 118563 - DNA, 25 bp, mus musculus
ttctgctggaaacttccataagggg

SEQ ID NO: 118564 - DNA, 25 bp, mus musculus
cttccataaggggcagcagttgagg

SEQ ID NO: 118565 - DNA, 25 bp, mus musculus
actccctaggctcaggtagcttgtt

SEQ ID NO: 118566 - DNA, 25 bp, mus musculus
ccctaggctcaggtagcttgttcct

SEQ ID NO: 118567 - DNA, 25 bp, mus musculus
tgaactcctgctgcctggtaggccc

SEQ ID NO: 118568 - DNA, 25 bp, mus musculus
gctgcctggtaggccccacaaggcc

SEQ ID NO: 118569 - DNA, 25 bp, mus musculus
ccacaaggcctagtctggaagcgta

SEQ ID NO: 118570 - DNA, 25 bp, mus musculus
ataatcctcagtgtaaaatgtcttg

SEQ ID NO: 118571 - DNA, 25 bp, mus musculus
cacgacggcagggcccagtgcttgc

SEQ ID NO: 118572 - DNA, 25 bp, mus musculus
ctgcagagctcttcctgggcgcttg

SEQ ID NO: 118573 - DNA, 25 bp, mus musculus
catgtccttgtcgagtctcatttcg

SEQ ID NO: 118574 - DNA, 25 bp, mus musculus
ccccgtgcacggttcaatggtagat

SEQ ID NO: 118575 - DNA, 25 bp, mus musculus
agattcgctgtcccctcagcaggga

SEQ ID NO: 118576 - DNA, 25 bp, mus musculus
ctccccaaagccactggaaggagca

SEQ ID NO: 118577 - DNA, 25 bp, mus musculus
aggagcacatactacctagaaggaa

SEQ ID NO: 118578 - DNA, 25 bp, mus musculus
acatactacctagaaggaagaagag

SEQ ID NO: 118579 - DNA, 25 bp, mus musculus
tgtagtcttgtcttagctccggacg

SEQ ID NO: 118580 - DNA, 25 bp, mus musculus
agtcttgtcttagctccggacgtga

SEQ ID NO: 118581 - DNA, 25 bp, mus musculus
cttgtcttagctccggacgtgaaat

SEQ ID NO: 118582 - DNA, 25 bp, mus musculus
ttagctccggacgtgaaatacttcg

SEQ ID NO: 118583 - DNA, 25 bp, mus musculus
cctcatcaggctctctggtgagaac

SEQ ID NO: 118584 - DNA, 25 bp, mus musculus
caggctctctggtgagaactgagaa

SEQ ID NO: 118585 - DNA, 25 bp, mus musculus
gctctctggtgagaactgagaatcg

SEQ ID NO: 118586 - DNA, 25 bp, mus musculus
ctgagaatcggactcacttgatgtc

SEQ ID NO: 118587 - DNA, 25 bp, mus musculus
atcggactcacttgatgtctcctgg

SEQ ID NO: 118588 - DNA, 25 bp, mus musculus
ctcacttgatgtctcctggaagcag

SEQ ID NO: 118589 - DNA, 25 bp, mus musculus
tgatgtctcctggaagcagagcaga

SEQ ID NO: 118590 - DNA, 25 bp, mus musculus
tgtctcctggaagcagagcagaatg

SEQ ID NO: 118591 - DNA, 25 bp, mus musculus
tttttgtacagtatcggaaggacat

SEQ ID NO: 118592 - DNA, 25 bp, mus musculus
aggacattatctacctgttctgtgg

SEQ ID NO: 118593 - DNA, 25 bp, mus musculus
gcattttggctgctgtttctaggtc

SEQ ID NO: 118594 - DNA, 25 bp, mus musculus
tggctgctgtttctaggtcctattc

SEQ ID NO: 118595 - DNA, 25 bp, mus musculus
ctgtttctaggtcctattcacgagc

SEQ ID NO: 118596 - DNA, 25 bp, mus musculus
ctaggtcctattcacgagcctcttt

SEQ ID NO: 118597 - DNA, 25 bp, mus musculus
cacgagcctctttctgtatatctga

SEQ ID NO: 118598 - DNA, 25 bp, mus musculus
tgtgttttctgtctccctctggctg

SEQ ID NO: 118599 - DNA, 25 bp, mus musculus
agatagcctctgctatagagactgc

SEQ ID NO: 118600 - DNA, 25 bp, mus musculus
ctatagagactgccagctagtgaat

SEQ ID NO: 118601 - DNA, 25 bp, mus musculus
agactgccagctagtgaatccccaa

SEQ ID NO: 118602 - DNA, 25 bp, mus musculus
ccagctagtgaatccccaacataaa

SEQ ID NO: 118603 - DNA, 25 bp, mus musculus
acctgttctgtggctttctggaatg

SEQ ID NO: 118604 - DNA, 25 bp, mus musculus
tgttttgtaagccctctttgaagct

SEQ ID NO: 118605 - DNA, 25 bp, mus musculus
gtaagccctctttgaagctgtcttt

SEQ ID NO: 118606 - DNA, 25 bp, mus musculus
cctctttgaagctgtctttgtgaac

SEQ ID NO: 118607 - DNA, 25 bp, mus musculus
cccatacttcccagtagcagtacta

SEQ ID NO: 118608 - DNA, 25 bp, mus musculus
gttgtatggagccctgaggatccac

SEQ ID NO: 118609 - DNA, 25 bp, mus musculus
cctgaggatccactagcttctgcgt

SEQ ID NO: 118610 - DNA, 25 bp, mus musculus
ctagcttctgcgtctggtgcatttt

SEQ ID NO: 118611 - DNA, 25 bp, mus musculus
cagggcagctctcagatcaggttca

SEQ ID NO: 118612 - DNA, 25 bp, mus musculus
agctctcagatcaggttcattttgg

SEQ ID NO: 118613 - DNA, 25 bp, mus musculus
ctgcatgtttcctttccttccaact

SEQ ID NO: 118614 - DNA, 25 bp, mus musculus
tgacagtgctgtttccccattcata

SEQ ID NO: 118615 - DNA, 25 bp, mus musculus
tgctgtttccccattcatacattcc

SEQ ID NO: 118616 - DNA, 25 bp, mus musculus
ttccccattcatacattcctatcct

SEQ ID NO: 118617 - DNA, 25 bp, mus musculus
attcatacattcctatcctcatttg

SEQ ID NO: 118618 - DNA, 25 bp, mus musculus
ctatcctcatttgacagaatgtaac

SEQ ID NO: 118619 - DNA, 25 bp, mus musculus
atgtaacttttcttgctgaccacag

SEQ ID NO: 118620 - DNA, 25 bp, mus musculus
tcctccaactttgaaatcaactctc

SEQ ID NO: 118621 - DNA, 25 bp, mus musculus
acccatcttgcaccagcaaagacaa

SEQ ID NO: 118622 - DNA, 25 bp, mus musculus
cttgcaccagcaaagacaagtctcc

SEQ ID NO: 118623 - DNA, 25 bp, mus musculus
gttgtgccctgatccaaacacacac

SEQ ID NO: 118624 - DNA, 25 bp, mus musculus
ctagagatgccctcaatgaggcact

SEQ ID NO: 118625 - DNA, 25 bp, mus musculus
aggcactccagtcccaaagtctcaa

SEQ ID NO: 118626 - DNA, 25 bp, mus musculus
cccaaagtctcaacatcccaatatg

SEQ ID NO: 118627 - DNA, 25 bp, mus musculus
acatcccaatatgtatcctatggaa

SEQ ID NO: 118628 - DNA, 25 bp, mus musculus
tggccattcctgtccccaagctgtt

SEQ ID NO: 118629 - DNA, 25 bp, mus musculus
tccccaagctgttgtgagctagaaa

SEQ ID NO: 118630 - DNA, 25 bp, mus musculus
tcgtattttccctgcaggaagtgtt

SEQ ID NO: 118631 - DNA, 25 bp, mus musculus
accagatccacttcttctttgccaa

SEQ ID NO: 118632 - DNA, 25 bp, mus musculus
acttcttctttgccaaactgaactg

SEQ ID NO: 118633 - DNA, 25 bp, mus musculus
cctctgacttggtatcagccaaccg

SEQ ID NO: 118634 - DNA, 25 bp, mus musculus
tggtatcagccaaccgcctttttgg

SEQ ID NO: 118635 - DNA, 25 bp, mus musculus
tatcagccaaccgcctttttggaga

SEQ ID NO: 118636 - DNA, 25 bp, mus musculus
tcaccttcaacgagagctatcaaga

SEQ ID NO: 118637 - DNA, 25 bp, mus musculus
atccagagtgaccatcaacaactgg

SEQ ID NO: 118638 - DNA, 25 bp, mus musculus
catcaaagatgtcatcccacagtgc

SEQ ID NO: 118639 - DNA, 25 bp, mus musculus
tgtcatcccacagtgcgccattaac

SEQ ID NO: 118640 - DNA, 25 bp, mus musculus
catcccacagtgcgccattaacgag

SEQ ID NO: 118641 - DNA, 25 bp, mus musculus
cccacagtgcgccattaacgagctc

SEQ ID NO: 118642 - DNA, 25 bp, mus musculus
gtgcgccattaacgagctcactgcc

SEQ ID NO: 118643 - DNA, 25 bp, mus musculus
tctttgccaaactgaactgccgact

SEQ ID NO: 118644 - DNA, 25 bp, mus musculus
ccaaactgaactgccgactctatcg

SEQ ID NO: 118645 - DNA, 25 bp, mus musculus
aactgaactgccgactctatcgaaa

SEQ ID NO: 118646 - DNA, 25 bp, mus musculus
tgaactgccgactctatcgaaaagc

SEQ ID NO: 118647 - DNA, 25 bp, mus musculus
gactctatcgaaaagccaacaagtc

SEQ ID NO: 118648 - DNA, 25 bp, mus musculus
tctatcgaaaagccaacaagtcctc

SEQ ID NO: 118649 - DNA, 25 bp, mus musculus
ccaacaagtcctctgacttggtatc

SEQ ID NO: 118650 - DNA, 25 bp, mus musculus
agtcctctgacttggtatcagccaa

SEQ ID NO: 118651 - DNA, 25 bp, mus musculus
tgccccacttaaggccaacatcatt

SEQ ID NO: 118652 - DNA, 25 bp, mus musculus
acttaaggccaacatcattgaggcg

SEQ ID NO: 118653 - DNA, 25 bp, mus musculus
catgaccattggctactctaggaca

SEQ ID NO: 118654 - DNA, 25 bp, mus musculus
gaccattggctactctaggacagtt

SEQ ID NO: 118655 - DNA, 25 bp, mus musculus
cattggctactctaggacagttgag

SEQ ID NO: 118656 - DNA, 25 bp, mus musculus
gaagttccacgttattgttgcagag

SEQ ID NO: 118657 - DNA, 25 bp, mus musculus
gttccacgttattgttgcagagtgc

SEQ ID NO: 118658 - DNA, 25 bp, mus musculus
tattgttgcagagtgcgctcctttc

SEQ ID NO: 118659 - DNA, 25 bp, mus musculus
tttctgccagggacatgaaatggcc

SEQ ID NO: 118660 - DNA, 25 bp, mus musculus
tgaaatggccgtcaatttgtccaaa

SEQ ID NO: 118661 - DNA, 25 bp, mus musculus
cgagacaactgtcatgactgatgcc

SEQ ID NO: 118662 - DNA, 25 bp, mus musculus
gacaactgtcatgactgatgccgcc

SEQ ID NO: 118663 - DNA, 25 bp, mus musculus
taaggccaacatcattgaggcgatt

SEQ ID NO: 118664 - DNA, 25 bp, mus musculus
aactgtcatgactgatgccgccatt

SEQ ID NO: 118665 - DNA, 25 bp, mus musculus
ggccaacatcattgaggcgattaat

SEQ ID NO: 118666 - DNA, 25 bp, mus musculus
ggagcacatccactccaacgaggtg

SEQ ID NO: 118667 - DNA, 25 bp, mus musculus
gcacatccactccaacgaggtgatc

SEQ ID NO: 118668 - DNA, 25 bp, mus musculus
catccactccaacgaggtgatcatg

SEQ ID NO: 118669 - DNA, 25 bp, mus musculus
ccactccaacgaggtgatcatgacc

SEQ ID NO: 118670 - DNA, 25 bp, mus musculus
ctccaacgaggtgatcatgaccatt

SEQ ID NO: 118671 - DNA, 25 bp, mus musculus
gatcatgaccattggctactctagg

SEQ ID NO: 118672 - DNA, 25 bp, mus musculus
atgtccagtacagccaggtgaccgg

SEQ ID NO: 118673 - DNA, 25 bp, mus musculus
ggctgaacgaaccactgtccaatga

SEQ ID NO: 118674 - DNA, 25 bp, mus musculus
ccgagcctaccgggagaagatcgag

SEQ ID NO: 118675 - DNA, 25 bp, mus musculus
aaggacgtgctgagcctgctggaca

SEQ ID NO: 118676 - DNA, 25 bp, mus musculus
acgtgctgagcctgctggacaacta

SEQ ID NO: 118677 - DNA, 25 bp, mus musculus
gtgctgagcctgctggacaactacc

SEQ ID NO: 118678 - DNA, 25 bp, mus musculus
gctgagcctgctggacaactacctg

SEQ ID NO: 118679 - DNA, 25 bp, mus musculus
cctgctggacaactacctgatcaaa

SEQ ID NO: 118680 - DNA, 25 bp, mus musculus
tgctggacaactacctgatcaaaga

SEQ ID NO: 118681 - DNA, 25 bp, mus musculus
ctggacaactacctgatcaaagaac

SEQ ID NO: 118682 - DNA, 25 bp, mus musculus
ggacaactacctgatcaaagaactg

SEQ ID NO: 118683 - DNA, 25 bp, mus musculus
acaactacctgatcaaagaactgca

SEQ ID NO: 118684 - DNA, 25 bp, mus musculus
ctgaacgaaccactgtccaatgagg

SEQ ID NO: 118685 - DNA, 25 bp, mus musculus
aactacctgatcaaagaactgcagc

SEQ ID NO: 118686 - DNA, 25 bp, mus musculus
gaacgaaccactgtccaatgaggaa

SEQ ID NO: 118687 - DNA, 25 bp, mus musculus
gggtcatcagcagcatcgagcagaa

SEQ ID NO: 118688 - DNA, 25 bp, mus musculus
gtcatcagcagcatcgagcagaaga

SEQ ID NO: 118689 - DNA, 25 bp, mus musculus
catcagcagcatcgagcagaagacg

SEQ ID NO: 118690 - DNA, 25 bp, mus musculus
tcagcagcatcgagcagaagacgtc

SEQ ID NO: 118691 - DNA, 25 bp, mus musculus
tggtccgagcctaccgggagaagat

SEQ ID NO: 118692 - DNA, 25 bp, mus musculus
gtccgagcctaccgggagaagatcg

SEQ ID NO: 118693 - DNA, 25 bp, mus musculus
ccagcaggtcctggagttggagaag

SEQ ID NO: 118694 - DNA, 25 bp, mus musculus
ccacaagttgcccaacaccaagatc

SEQ ID NO: 118695 - DNA, 25 bp, mus musculus
cccccaagcaggagttcgaacatgg

SEQ ID NO: 118696 - DNA, 25 bp, mus musculus
cctaccctcactttatctatatgga

SEQ ID NO: 118697 - DNA, 25 bp, mus musculus
taccctcactttatctatatggaat

SEQ ID NO: 118698 - DNA, 25 bp, mus musculus
accctcactttatctatatggaata

SEQ ID NO: 118699 - DNA, 25 bp, mus musculus
ccctcactttatctatatggaataa

SEQ ID NO: 118700 - DNA, 25 bp, mus musculus
ctcactttatctatatggaataaac

SEQ ID NO: 118701 - DNA, 25 bp, mus musculus
taaagtcttcggagacaagattcga

SEQ ID NO: 118702 - DNA, 25 bp, mus musculus
caagattcgagtctcttgctttctt

SEQ ID NO: 118703 - DNA, 25 bp, mus musculus
aagattcgagtctcttgctttcttc

SEQ ID NO: 118704 - DNA, 25 bp, mus musculus
agattcgagtctcttgctttcttcc

SEQ ID NO: 118705 - DNA, 25 bp, mus musculus
cacaagttgcccaacaccaagatcc

SEQ ID NO: 118706 - DNA, 25 bp, mus musculus
caagttgcccaacaccaagatccgc

SEQ ID NO: 118707 - DNA, 25 bp, mus musculus
aagttgcccaacaccaagatccgct

SEQ ID NO: 118708 - DNA, 25 bp, mus musculus
agttgcccaacaccaagatccgctc

SEQ ID NO: 118709 - DNA, 25 bp, mus musculus
ttgcccaacaccaagatccgctcgg

SEQ ID NO: 118710 - DNA, 25 bp, mus musculus
gcccaacaccaagatccgctcgggt

SEQ ID NO: 118711 - DNA, 25 bp, mus musculus
caacaccaagatccgctcgggtggc

SEQ ID NO: 118712 - DNA, 25 bp, mus musculus
aacaccaagatccgctcgggtggca

SEQ ID NO: 118713 - DNA, 25 bp, mus musculus
gtccccatctcggaggctgcagact

SEQ ID NO: 118714 - DNA, 25 bp, mus musculus
cccatctcggaggctgcagactaag

SEQ ID NO: 118715 - DNA, 25 bp, mus musculus
gaaggccaccaatgtgccttttgtg

SEQ ID NO: 118716 - DNA, 25 bp, mus musculus
caatgtgccttttgtgctcattggc

SEQ ID NO: 118717 - DNA, 25 bp, mus musculus
cacaggcactgtcattattctcttg

SEQ ID NO: 118718 - DNA, 25 bp, mus musculus
aggcactgtcattattctcttgggc

SEQ ID NO: 118719 - DNA, 25 bp, mus musculus
cattattctcttgggcacctttggt

SEQ ID NO: 118720 - DNA, 25 bp, mus musculus
tattctcttgggcacctttggttgt

SEQ ID NO: 118721 - DNA, 25 bp, mus musculus
tggttgtttcgctacctgtcgagcc

SEQ ID NO: 118722 - DNA, 25 bp, mus musculus
ttgtttcgctacctgtcgagcctcc

SEQ ID NO: 118723 - DNA, 25 bp, mus musculus
ctccgcctggatgctgaaactgtac

SEQ ID NO: 118724 - DNA, 25 bp, mus musculus
cgcctggatgctgaaactgtacgcg

SEQ ID NO: 118725 - DNA, 25 bp, mus musculus
gctgcagactaagccggtcattact

SEQ ID NO: 118726 - DNA, 25 bp, mus musculus
cttgatctacactttcatcttttgg

SEQ ID NO: 118727 - DNA, 25 bp, mus musculus
gatctacactttcatcttttggatc

SEQ ID NO: 118728 - DNA, 25 bp, mus musculus
ctacactttcatcttttggatcact

SEQ ID NO: 118729 - DNA, 25 bp, mus musculus
catcttttggatcactggtgttatc

SEQ ID NO: 118730 - DNA, 25 bp, mus musculus
cactggtgttatccttcttgccgtt

SEQ ID NO: 118731 - DNA, 25 bp, mus musculus
tggtgttatccttcttgccgttggc

SEQ ID NO: 118732 - DNA, 25 bp, mus musculus
tcttgccgttggcatttggggcaag

SEQ ID NO: 118733 - DNA, 25 bp, mus musculus
cctgagcatgccactcgtggccaag

SEQ ID NO: 118734 - DNA, 25 bp, mus musculus
gccactcgtggccaagctcccttgt

SEQ ID NO: 118735 - DNA, 25 bp, mus musculus
tatcttgtccctttgaggccccaca

SEQ ID NO: 118736 - DNA, 25 bp, mus musculus
cttgtccctttgaggccccacatca

SEQ ID NO: 118737 - DNA, 25 bp, mus musculus
cctttgaggccccacatcaagtgtc

SEQ ID NO: 118738 - DNA, 25 bp, mus musculus
ttgaggccccacatcaagtgtcacc

SEQ ID NO: 118739 - DNA, 25 bp, mus musculus
gcttacttggttcatgcttcttgtg

SEQ ID NO: 118740 - DNA, 25 bp, mus musculus
ttggttcatgcttcttgtgtgacac

SEQ ID NO: 118741 - DNA, 25 bp, mus musculus
gttcatgcttcttgtgtgacacttc

SEQ ID NO: 118742 - DNA, 25 bp, mus musculus
catgcttcttgtgtgacacttctcg

SEQ ID NO: 118743 - DNA, 25 bp, mus musculus
tcttgtgtgacacttctcgctgttt

SEQ ID NO: 118744 - DNA, 25 bp, mus musculus
tgtgtgacacttctcgctgttttat

SEQ ID NO: 118745 - DNA, 25 bp, mus musculus
actcgtggccaagctcccttgttat

SEQ ID NO: 118746 - DNA, 25 bp, mus musculus
ggccaagctcccttgttatttgctc

SEQ ID NO: 118747 - DNA, 25 bp, mus musculus
caagctcccttgttatttgctctgt

SEQ ID NO: 118748 - DNA, 25 bp, mus musculus
gctcccttgttatttgctctgtagt

SEQ ID NO: 118749 - DNA, 25 bp, mus musculus
ctgtagttccctctgcctgggatgc

SEQ ID NO: 118750 - DNA, 25 bp, mus musculus
tagttccctctgcctgggatgccct

SEQ ID NO: 118751 - DNA, 25 bp, mus musculus
tctatgcctggcagttatcttgtcc

SEQ ID NO: 118752 - DNA, 25 bp, mus musculus
atgcctggcagttatcttgtccctt

SEQ ID NO: 118753 - DNA, 25 bp, mus musculus
cgccatcttccgtctcaaaaagaca

SEQ ID NO: 118754 - DNA, 25 bp, mus musculus
ctgtgtcccttacctggggatgtat

SEQ ID NO: 118755 - DNA, 25 bp, mus musculus
tcagcagactacctacaaaatcgac

SEQ ID NO: 118756 - DNA, 25 bp, mus musculus
cctgtatgagtcttcgctcctaatc

SEQ ID NO: 118757 - DNA, 25 bp, mus musculus
tgagtcttcgctcctaatcgaacca

SEQ ID NO: 118758 - DNA, 25 bp, mus musculus
agctgcttctgtgaacacctgcttt

SEQ ID NO: 118759 - DNA, 25 bp, mus musculus
ttctgtgaacacctgctttacgatt

SEQ ID NO: 118760 - DNA, 25 bp, mus musculus
gaacacctgctttacgattattgta

SEQ ID NO: 118761 - DNA, 25 bp, mus musculus
atataatcgtcgcgtgcctctgtac

SEQ ID NO: 118762 - DNA, 25 bp, mus musculus
cgtgcctctgtacttgttctccagc

SEQ ID NO: 118763 - DNA, 25 bp, mus musculus
cttgttctccagcgtgtgcttcccc

SEQ ID NO: 118764 - DNA, 25 bp, mus musculus
ctccagcgtgtgcttccccgagaat

SEQ ID NO: 118765 - DNA, 25 bp, mus musculus
tctcaccgacttggtgttcatcgag

SEQ ID NO: 118766 - DNA, 25 bp, mus musculus
gacacccaattacacagaggacggc

SEQ ID NO: 118767 - DNA, 25 bp, mus musculus
caattacacagaggacggcctggtc

SEQ ID NO: 118768 - DNA, 25 bp, mus musculus
caacttctccaagatgagaatgatc

SEQ ID NO: 118769 - DNA, 25 bp, mus musculus
aatgatctcccatattatccgagag

SEQ ID NO: 118770 - DNA, 25 bp, mus musculus
tattatccgagagattcgccagttt

SEQ ID NO: 118771 - DNA, 25 bp, mus musculus
gattcgccagtttcagcagactacc

SEQ ID NO: 118772 - DNA, 25 bp, mus musculus
ccagtttcagcagactacctacaaa

SEQ ID NO: 118773 - DNA, 25 bp, mus musculus
tgcctaaacgctgctatgtgagcca

SEQ ID NO: 118774 - DNA, 25 bp, mus musculus
aacgctgctatgtgagccacttaaa

SEQ ID NO: 118775 - DNA, 25 bp, mus musculus
ttcagcttcctgagatgatcaaagc

SEQ ID NO: 118776 - DNA, 25 bp, mus musculus
agggtttcctctatgtagctaagct

SEQ ID NO: 118777 - DNA, 25 bp, mus musculus
tcctctatgtagctaagctgcttca

SEQ ID NO: 118778 - DNA, 25 bp, mus musculus
atgtagctaagctgcttcaatgatg

SEQ ID NO: 118779 - DNA, 25 bp, mus musculus
ctaagctgcttcaatgatgatcttc

SEQ ID NO: 118780 - DNA, 25 bp, mus musculus
gatcttcatattgtgctccagtttg

SEQ ID NO: 118781 - DNA, 25 bp, mus musculus
ttaaagtgcgctcctacctcttcgt

SEQ ID NO: 118782 - DNA, 25 bp, mus musculus
cacaatcactgtttagttagtagcg

SEQ ID NO: 118783 - DNA, 25 bp, mus musculus
gaattataccttggcatcagttact

SEQ ID NO: 118784 - DNA, 25 bp, mus musculus
taccttggcatcagttactcaaact

SEQ ID NO: 118785 - DNA, 25 bp, mus musculus
tgagccacttaaaattctcgggtgc

SEQ ID NO: 118786 - DNA, 25 bp, mus musculus
acttaaaattctcgggtgcagagtg

SEQ ID NO: 118787 - DNA, 25 bp, mus musculus
aattctcgggtgcagagtggcaggc

SEQ ID NO: 118788 - DNA, 25 bp, mus musculus
gtcagaaacgtatctctctgaagtt

SEQ ID NO: 118789 - DNA, 25 bp, mus musculus
aacgtatctctctgaagttgtttca

SEQ ID NO: 118790 - DNA, 25 bp, mus musculus
aatttcctggacagactacatatat

SEQ ID NO: 118791 - DNA, 25 bp, mus musculus
agactacatatattcagcttcctga

SEQ ID NO: 118792 - DNA, 25 bp, mus musculus
catatattcagcttcctgagatgat

SEQ ID NO: 118793 - DNA, 25 bp, mus musculus
gaccacctgcaaaaatgacatgtgt

SEQ ID NO: 118794 - DNA, 25 bp, mus musculus
gggactccagcatgaccacacagat

SEQ ID NO: 118795 - DNA, 25 bp, mus musculus
gctctgtggagttgggcagcatgtc

SEQ ID NO: 118796 - DNA, 25 bp, mus musculus
gcatgtcacctgccacctggacctg

SEQ ID NO: 118797 - DNA, 25 bp, mus musculus
ccacctggacctgagcacctgtgga

SEQ ID NO: 118798 - DNA, 25 bp, mus musculus
cctggacctgagcacctgtggactc

SEQ ID NO: 118799 - DNA, 25 bp, mus musculus
actcccggatctccttgatcttgga

SEQ ID NO: 118800 - DNA, 25 bp, mus musculus
cccggatctccttgatcttggagcc

SEQ ID NO: 118801 - DNA, 25 bp, mus musculus
ctttgccgatcagggacccacactg

SEQ ID NO: 118802 - DNA, 25 bp, mus musculus
cagggaccactagtcgcagtgtcac

SEQ ID NO: 118803 - DNA, 25 bp, mus musculus
ggaccactagtcgcagtgtcactgg

SEQ ID NO: 118804 - DNA, 25 bp, mus musculus
ccactagtcgcagtgtcactggagg

SEQ ID NO: 118805 - DNA, 25 bp, mus musculus
actccagcatgaccacacagatctg

SEQ ID NO: 118806 - DNA, 25 bp, mus musculus
tgaccacacagatctgtttcacaca

SEQ ID NO: 118807 - DNA, 25 bp, mus musculus
ccacacagatctgtttcacacactg

SEQ ID NO: 118808 - DNA, 25 bp, mus musculus
cacagatctgtttcacacactggaa

SEQ ID NO: 118809 - DNA, 25 bp, mus musculus
tcacacactggaatatggcgtctgg

SEQ ID NO: 118810 - DNA, 25 bp, mus musculus
atatggcgtctggggtccctgagat

SEQ ID NO: 118811 - DNA, 25 bp, mus musculus
agatagtcactgcccgctctgtgga

SEQ ID NO: 118812 - DNA, 25 bp, mus musculus
cccgctctgtggagttgggcagcat

SEQ ID NO: 118813 - DNA, 25 bp, mus musculus
agatagacatcctggacaccgctgg

SEQ ID NO: 118814 - DNA, 25 bp, mus musculus
acatcctggacaccgctggccagga

SEQ ID NO: 118815 - DNA, 25 bp, mus musculus
tggtgttctccatcacagagcacga

SEQ ID NO: 118816 - DNA, 25 bp, mus musculus
tctccatcacagagcacgagtcttt

SEQ ID NO: 118817 - DNA, 25 bp, mus musculus
cagagcacgagtctttcacagccac

SEQ ID NO: 118818 - DNA, 25 bp, mus musculus
agtctttcacagccacagccgagtt

SEQ ID NO: 118819 - DNA, 25 bp, mus musculus
ctttcacagccacagccgagttcag

SEQ ID NO: 118820 - DNA, 25 bp, mus musculus
tcacagccacagccgagttcaggga

SEQ ID NO: 118821 - DNA, 25 bp, mus musculus
aacagattctccgagtcaagtcaga

SEQ ID NO: 118822 - DNA, 25 bp, mus musculus
tcccactgctggtcgtgggcaacaa

SEQ ID NO: 118823 - DNA, 25 bp, mus musculus
gcaacaagtccgacctggaggagcg

SEQ ID NO: 118824 - DNA, 25 bp, mus musculus
acaagtccgacctggaggagcggag

SEQ ID NO: 118825 - DNA, 25 bp, mus musculus
acaccgctggccaggaggactatgc

SEQ ID NO: 118826 - DNA, 25 bp, mus musculus
ccgctggccaggaggactatgcggc

SEQ ID NO: 118827 - DNA, 25 bp, mus musculus
aggactatgcggccatccgtgacaa

SEQ ID NO: 118828 - DNA, 25 bp, mus musculus
atgcggccatccgtgacaactactt

SEQ ID NO: 118829 - DNA, 25 bp, mus musculus
cggccatccgtgacaactacttccg

SEQ ID NO: 118830 - DNA, 25 bp, mus musculus
gtgacaactacttccgaagcggaga

SEQ ID NO: 118831 - DNA, 25 bp, mus musculus
gctttctgctggtgttctccatcac

SEQ ID NO: 118832 - DNA, 25 bp, mus musculus
ttctgctggtgttctccatcacaga

SEQ ID NO: 118833 - DNA, 25 bp, mus musculus
ctggccggcagcaagcacaaagagg

SEQ ID NO: 118834 - DNA, 25 bp, mus musculus
ccggcagcaagcacaaagaggagaa

SEQ ID NO: 118835 - DNA, 25 bp, mus musculus
gcccgtgttctcaatctcactgagc

SEQ ID NO: 118836 - DNA, 25 bp, mus musculus
cccgtgttctcaatctcactgagcg

SEQ ID NO: 118837 - DNA, 25 bp, mus musculus
cgtgttctcaatctcactgagcggc

SEQ ID NO: 118838 - DNA, 25 bp, mus musculus
gtgttctcaatctcactgagcggca

SEQ ID NO: 118839 - DNA, 25 bp, mus musculus
ttctcaatctcactgagcggcaggt

SEQ ID NO: 118840 - DNA, 25 bp, mus musculus
cagactgctgcctcggcacagccaa

SEQ ID NO: 118841 - DNA, 25 bp, mus musculus
gttagttctatccatcgaggaggag

SEQ ID NO: 118842 - DNA, 25 bp, mus musculus
tcttccccagcgcaactgaaataaa

SEQ ID NO: 118843 - DNA, 25 bp, mus musculus
tccccagcgcaactgaaataaatga

SEQ ID NO: 118844 - DNA, 25 bp, mus musculus
ccccagcgcaactgaaataaatgac

SEQ ID NO: 118845 - DNA, 25 bp, mus musculus
gcaaccccgtggccaactggatcca

SEQ ID NO: 118846 - DNA, 25 bp, mus musculus
gcccgttccacaaggaagaagcgct

SEQ ID NO: 118847 - DNA, 25 bp, mus musculus
gagtttctcttcaatatgtatttaa

SEQ ID NO: 118848 - DNA, 25 bp, mus musculus
tttctcttcaatatgtatttaacca

SEQ ID NO: 118849 - DNA, 25 bp, mus musculus
ttctcttcaatatgtatttaaccag

SEQ ID NO: 118850 - DNA, 25 bp, mus musculus
tacgaggtggcccgtgttctcaatc

SEQ ID NO: 118851 - DNA, 25 bp, mus musculus
aggtggcccgtgttctcaatctcac

SEQ ID NO: 118852 - DNA, 25 bp, mus musculus
gtggcccgtgttctcaatctcactg

SEQ ID NO: 118853 - DNA, 25 bp, mus musculus
agcgccgttttgccattggctctca

SEQ ID NO: 118854 - DNA, 25 bp, mus musculus
ccattggctctcaggtgtctgaaca

SEQ ID NO: 118855 - DNA, 25 bp, mus musculus
ctgctctgggtgtctatcccctgtc

SEQ ID NO: 118856 - DNA, 25 bp, mus musculus
tctatcccctgtcatgccttctcaa

SEQ ID NO: 118857 - DNA, 25 bp, mus musculus
ccctgtcatgccttctcaacaagat

SEQ ID NO: 118858 - DNA, 25 bp, mus musculus
catgccttctcaacaagatgagtct

SEQ ID NO: 118859 - DNA, 25 bp, mus musculus
ttctcaacaagatgagtctggagca

SEQ ID NO: 118860 - DNA, 25 bp, mus musculus
gtatattggctcccgggccactcac

SEQ ID NO: 118861 - DNA, 25 bp, mus musculus
cactcactgccaagcttctttgtat

SEQ ID NO: 118862 - DNA, 25 bp, mus musculus
ctgccaagcttctttgtatgtacag

SEQ ID NO: 118863 - DNA, 25 bp, mus musculus
caattgagtccctggctgctaaggt

SEQ ID NO: 118864 - DNA, 25 bp, mus musculus
agtccctggctgctaaggtcagtgg

SEQ ID NO: 118865 - DNA, 25 bp, mus musculus
aatatccagagcacgctatccgaaa

SEQ ID NO: 118866 - DNA, 25 bp, mus musculus
tgcagctcatgctacgcaggggtga

SEQ ID NO: 118867 - DNA, 25 bp, mus musculus
agatccaacaccgtatgcagcgcaa

SEQ ID NO: 118868 - DNA, 25 bp, mus musculus
agtgagcccattgcccatcaaccct

SEQ ID NO: 118869 - DNA, 25 bp, mus musculus
tcagtgctccaaacctccttttgcc

SEQ ID NO: 118870 - DNA, 25 bp, mus musculus
gtctgcagcacatctgcagcccctg

SEQ ID NO: 118871 - DNA, 25 bp, mus musculus
agcacatctgcagcccctggaaatg

SEQ ID NO: 118872 - DNA, 25 bp, mus musculus
tctgcagcccctggaaatgtacttt

SEQ ID NO: 118873 - DNA, 25 bp, mus musculus
tagcactttcattggagggtatttg

SEQ ID NO: 118874 - DNA, 25 bp, mus musculus
cgctgctccggttgctaattcaatg

SEQ ID NO: 118875 - DNA, 25 bp, mus musculus
ctgttccatgacttcaggggccatc

SEQ ID NO: 118876 - DNA, 25 bp, mus musculus
ttccatgacttcaggggccatccaa

SEQ ID NO: 118877 - DNA, 25 bp, mus musculus
gacttcaggggccatccaacatggg

SEQ ID NO: 118878 - DNA, 25 bp, mus musculus
ttcaggggccatccaacatggggta

SEQ ID NO: 118879 - DNA, 25 bp, mus musculus
catccaacatggggtaccaacaaat

SEQ ID NO: 118880 - DNA, 25 bp, mus musculus
tgcgcttactccaaaatctgctatt

SEQ ID NO: 118881 - DNA, 25 bp, mus musculus
gcttactccaaaatctgctatttgt

SEQ ID NO: 118882 - DNA, 25 bp, mus musculus
tactccaaaatctgctatttgtact

SEQ ID NO: 118883 - DNA, 25 bp, mus musculus
atctgctatttgtactgagccatcc

SEQ ID NO: 118884 - DNA, 25 bp, mus musculus
tgctatttgtactgagccatcctca

SEQ ID NO: 118885 - DNA, 25 bp, mus musculus
tgctccggttgctaattcaatggca

SEQ ID NO: 118886 - DNA, 25 bp, mus musculus
tccggttgctaattcaatggcagtt

SEQ ID NO: 118887 - DNA, 25 bp, mus musculus
agttattccaaaactccacatatca

SEQ ID NO: 118888 - DNA, 25 bp, mus musculus
actccacatatcagccttgaagtca

SEQ ID NO: 118889 - DNA, 25 bp, mus musculus
ccacatatcagccttgaagtcatag

SEQ ID NO: 118890 - DNA, 25 bp, mus musculus
atcagccttgaagtcatagcctctc

SEQ ID NO: 118891 - DNA, 25 bp, mus musculus
gcctctcacctgttccatgacttca

SEQ ID NO: 118892 - DNA, 25 bp, mus musculus
cacctgttccatgacttcaggggcc

SEQ ID NO: 118893 - DNA, 25 bp, mus musculus
tgaagcaaatcgcgatcgcgtggca

SEQ ID NO: 118894 - DNA, 25 bp, mus musculus
tcgcgatcgcgtggcagccaaaaat

SEQ ID NO: 118895 - DNA, 25 bp, mus musculus
catcatcagcaaactttaccaaggc

SEQ ID NO: 118896 - DNA, 25 bp, mus musculus
ctctggagggcccaccatcgaggaa

SEQ ID NO: 118897 - DNA, 25 bp, mus musculus
gcccaccatcgaggaagtggactag

SEQ ID NO: 118898 - DNA, 25 bp, mus musculus
agtggactaggcttgcgctggagtc

SEQ ID NO: 118899 - DNA, 25 bp, mus musculus
ctaggcttgcgctggagtccgcgta

SEQ ID NO: 118900 - DNA, 25 bp, mus musculus
ttaaatgtccttgtgccaagtaaga

SEQ ID NO: 118901 - DNA, 25 bp, mus musculus
aatgtccttgtgccaagtaagatct

SEQ ID NO: 118902 - DNA, 25 bp, mus musculus
gtccttgtgccaagtaagatctatt

SEQ ID NO: 118903 - DNA, 25 bp, mus musculus
tggaagtctttagcctggtgcatac

SEQ ID NO: 118904 - DNA, 25 bp, mus musculus
aagtctttagcctggtgcatacata

SEQ ID NO: 118905 - DNA, 25 bp, mus musculus
cgatcgcgtggcagccaaaaatgcg

SEQ ID NO: 118906 - DNA, 25 bp, mus musculus
tcgcgtggcagccaaaaatgcggtg

SEQ ID NO: 118907 - DNA, 25 bp, mus musculus
ggagtcctatacctacaacatcaag

SEQ ID NO: 118908 - DNA, 25 bp, mus musculus
gtcctatacctacaacatcaagcag

SEQ ID NO: 118909 - DNA, 25 bp, mus musculus
ctatacctacaacatcaagcagacc

SEQ ID NO: 118910 - DNA, 25 bp, mus musculus
tacctacaacatcaagcagaccgtg

SEQ ID NO: 118911 - DNA, 25 bp, mus musculus
caagcagaccgtggaagacgagaaa

SEQ ID NO: 118912 - DNA, 25 bp, mus musculus
ccccatcatcagcaaactttaccaa

SEQ ID NO: 118913 - DNA, 25 bp, mus musculus
tgctgagtccaatctacagatatat

SEQ ID NO: 118914 - DNA, 25 bp, mus musculus
acttggtcacactgacagctagtac

SEQ ID NO: 118915 - DNA, 25 bp, mus musculus
tttagtgccttaatcaagtcaccaa

SEQ ID NO: 118916 - DNA, 25 bp, mus musculus
gccttaatcaagtcaccaaagcctt

SEQ ID NO: 118917 - DNA, 25 bp, mus musculus
atcaagtcaccaaagccttgccagt

SEQ ID NO: 118918 - DNA, 25 bp, mus musculus
tgccagtcactgacccagccacaag

SEQ ID NO: 118919 - DNA, 25 bp, mus musculus
acccagccacaagccttctttctga

SEQ ID NO: 118920 - DNA, 25 bp, mus musculus
gcaccacttgtacctcagagctctc

SEQ ID NO: 118921 - DNA, 25 bp, mus musculus
cttgtacctcagagctctctccatt

SEQ ID NO: 118922 - DNA, 25 bp, mus musculus
aaagcatgtatagccttccgaaaat

SEQ ID NO: 118923 - DNA, 25 bp, mus musculus
tgtatagccttccgaaaattctgct

SEQ ID NO: 118924 - DNA, 25 bp, mus musculus
cgaaaattctgctagctttatgaag

SEQ ID NO: 118925 - DNA, 25 bp, mus musculus
tcacactgacagctagtacgttcac

SEQ ID NO: 118926 - DNA, 25 bp, mus musculus
caaagtctcagtgatgggaagatga

SEQ ID NO: 118927 - DNA, 25 bp, mus musculus
atggagacatggccctgggtattac

SEQ ID NO: 118928 - DNA, 25 bp, mus musculus
gtattaccagtccagtaaggacagt

SEQ ID NO: 118929 - DNA, 25 bp, mus musculus
acaggtgctgttgccttcttttgac

SEQ ID NO: 118930 - DNA, 25 bp, mus musculus
gctgttgccttcttttgacacagag

SEQ ID NO: 118931 - DNA, 25 bp, mus musculus
gccttcttttgacacagaggccaat

SEQ ID NO: 118932 - DNA, 25 bp, mus musculus
ttttgacacagaggccaatttagtg

SEQ ID NO: 118933 - DNA, 25 bp, mus musculus
acacaaagtgccagtgatggaaaaa

SEQ ID NO: 118934 - DNA, 25 bp, mus musculus
ggtacatggctctgggagttataag

SEQ ID NO: 118935 - DNA, 25 bp, mus musculus
ctttctcaagtcaccagaagccttg

SEQ ID NO: 118936 - DNA, 25 bp, mus musculus
caagtcaccagaagccttgccagtc

SEQ ID NO: 118937 - DNA, 25 bp, mus musculus
aacatagctgagtctcagttcttag

SEQ ID NO: 118938 - DNA, 25 bp, mus musculus
gctgagtctcagttcttaggcttca

SEQ ID NO: 118939 - DNA, 25 bp, mus musculus
tctcagttcttaggcttcagcaatt

SEQ ID NO: 118940 - DNA, 25 bp, mus musculus
cagttcttaggcttcagcaattaca

SEQ ID NO: 118941 - DNA, 25 bp, mus musculus
ttcttaggcttcagcaattacaatt

SEQ ID NO: 118942 - DNA, 25 bp, mus musculus
ctaaatcatatcctgcctttggtaa

SEQ ID NO: 118943 - DNA, 25 bp, mus musculus
ttggtaaaatcccattgctttctga

SEQ ID NO: 118944 - DNA, 25 bp, mus musculus
gtaaaatcccattgctttctgaagc

SEQ ID NO: 118945 - DNA, 25 bp, mus musculus
agtacagaggcacaagccaggtcct

SEQ ID NO: 118946 - DNA, 25 bp, mus musculus
gaggcacaagccaggtcctgctgtc

SEQ ID NO: 118947 - DNA, 25 bp, mus musculus
gcacaagccaggtcctgctgtctcc

SEQ ID NO: 118948 - DNA, 25 bp, mus musculus
aggtcctgctgtctcctgtagacac

SEQ ID NO: 118949 - DNA, 25 bp, mus musculus
tgctgtctcctgtagacacagagac

SEQ ID NO: 118950 - DNA, 25 bp, mus musculus
agaccaacttggtatctttctcaag

SEQ ID NO: 118951 - DNA, 25 bp, mus musculus
ccaacttggtatctttctcaagtca

SEQ ID NO: 118952 - DNA, 25 bp, mus musculus
tggtatctttctcaagtcaccagaa

SEQ ID NO: 118953 - DNA, 25 bp, mus musculus
acaataactgcggcatcgagatcta

SEQ ID NO: 118954 - DNA, 25 bp, mus musculus
ataactgcggcatcgagatctacta

SEQ ID NO: 118955 - DNA, 25 bp, mus musculus
agccttgcttcaataccctgcgcac

SEQ ID NO: 118956 - DNA, 25 bp, mus musculus
gcttcaataccctgcgcaccaagga

SEQ ID NO: 118957 - DNA, 25 bp, mus musculus
ccctgcgcaccaaggagcagcttgg

SEQ ID NO: 118958 - DNA, 25 bp, mus musculus
gctatattgtcttcagtggaccccg

SEQ ID NO: 118959 - DNA, 25 bp, mus musculus
atattgtcttcagtggaccccgtcg

SEQ ID NO: 118960 - DNA, 25 bp, mus musculus
acggtatccaaggcttgcgcttcat

SEQ ID NO: 118961 - DNA, 25 bp, mus musculus
gtatccaaggcttgcgcttcatcat

SEQ ID NO: 118962 - DNA, 25 bp, mus musculus
gcttgcgcttcatcatccagtcaga

SEQ ID NO: 118963 - DNA, 25 bp, mus musculus
tgcgcttcatcatccagtcagaaaa

SEQ ID NO: 118964 - DNA, 25 bp, mus musculus
gcttcatcatccagtcagaaaaacc

SEQ ID NO: 118965 - DNA, 25 bp, mus musculus
gcatcgagatctactaccagacaga

SEQ ID NO: 118966 - DNA, 25 bp, mus musculus
tcgagatctactaccagacagacat

SEQ ID NO: 118967 - DNA, 25 bp, mus musculus
actaccagacagacatgcagagcac

SEQ ID NO: 118968 - DNA, 25 bp, mus musculus
cagacatgcagagcacctcggagaa

SEQ ID NO: 118969 - DNA, 25 bp, mus musculus
tgcagagcacctcggagaacatgtt

SEQ ID NO: 118970 - DNA, 25 bp, mus musculus
acatgttcctggagctgttttgcca

SEQ ID NO: 118971 - DNA, 25 bp, mus musculus
tcctggagctgttttgccagattat

SEQ ID NO: 118972 - DNA, 25 bp, mus musculus
ttatctcggagccttgcttcaatac

SEQ ID NO: 118973 - DNA, 25 bp, mus musculus
ggactgaagactgctggtggccaga

SEQ ID NO: 118974 - DNA, 25 bp, mus musculus
ctgaagactgctggtggccagagag

SEQ ID NO: 118975 - DNA, 25 bp, mus musculus
cttatcatcctcatttccatccttg

SEQ ID NO: 118976 - DNA, 25 bp, mus musculus
atcatcctcatttccatccttgtcg

SEQ ID NO: 118977 - DNA, 25 bp, mus musculus
ctcatttccatccttgtcggctgcc

SEQ ID NO: 118978 - DNA, 25 bp, mus musculus
atttccatccttgtcggctgccaac

SEQ ID NO: 118979 - DNA, 25 bp, mus musculus
gtcggctgccaacctgctcatcgtc

SEQ ID NO: 118980 - DNA, 25 bp, mus musculus
gctcatcgtcaccgggaccttcgtc

SEQ ID NO: 118981 - DNA, 25 bp, mus musculus
caccgggaccttcgtcatggccatc

SEQ ID NO: 118982 - DNA, 25 bp, mus musculus
cgtcatggccatcggttcgtgggct

SEQ ID NO: 118983 - DNA, 25 bp, mus musculus
catggccatcggttcgtgggctgca

SEQ ID NO: 118984 - DNA, 25 bp, mus musculus
tgcattggggccctcaaggagaaca

SEQ ID NO: 118985 - DNA, 25 bp, mus musculus
aagactgctggtggccagagagctg

SEQ ID NO: 118986 - DNA, 25 bp, mus musculus
agagctgaagcgctgcagcatggcg

SEQ ID NO: 118987 - DNA, 25 bp, mus musculus
cgtcaagtacctcatgttcgccttc

SEQ ID NO: 118988 - DNA, 25 bp, mus musculus
gtacctcatgttcgccttcaacctg

SEQ ID NO: 118989 - DNA, 25 bp, mus musculus
catgttcgccttcaacctgctcttc

SEQ ID NO: 118990 - DNA, 25 bp, mus musculus
tggcatctggttggcttccacacag

SEQ ID NO: 118991 - DNA, 25 bp, mus musculus
catctggttggcttccacacaggga

SEQ ID NO: 118992 - DNA, 25 bp, mus musculus
aaactttgccaccttatcatcctca

SEQ ID NO: 118993 - DNA, 25 bp, mus musculus
ctccctaggtgctgccagtgaggat

SEQ ID NO: 118994 - DNA, 25 bp, mus musculus
aggtgctgccagtgaggatgacccg

SEQ ID NO: 118995 - DNA, 25 bp, mus musculus
acaagatctgccagtcggagctcaa

SEQ ID NO: 118996 - DNA, 25 bp, mus musculus
gccagtcggagctcaaggagttgtt

SEQ ID NO: 118997 - DNA, 25 bp, mus musculus
tgcccacctggacgccgagtgagtt

SEQ ID NO: 118998 - DNA, 25 bp, mus musculus
tggataccaacaaagactgcgaagt

SEQ ID NO: 118999 - DNA, 25 bp, mus musculus
ataccaacaaagactgcgaagtgga

SEQ ID NO: 119000 - DNA, 25 bp, mus musculus
ccaacaaagactgcgaagtggactt

SEQ ID NO: 119001 - DNA, 25 bp, mus musculus
agtacgtgcgctcacttgccagcct

SEQ ID NO: 119002 - DNA, 25 bp, mus musculus
gctcacttgccagcctctgtctcta

SEQ ID NO: 119003 - DNA, 25 bp, mus musculus
cacttgccagcctctgtctctactg

SEQ ID NO: 119004 - DNA, 25 bp, mus musculus
ttgccagcctctgtctctactgcca

SEQ ID NO: 119005 - DNA, 25 bp, mus musculus
ggcccctggagcaggcagtagctgc

SEQ ID NO: 119006 - DNA, 25 bp, mus musculus
gcctctgtctctactgccacgagta

SEQ ID NO: 119007 - DNA, 25 bp, mus musculus
aggcagtagctgccatcgtgtgcac

SEQ ID NO: 119008 - DNA, 25 bp, mus musculus
tagctgccatcgtgtgcaccttcca

SEQ ID NO: 119009 - DNA, 25 bp, mus musculus
ctgccatcgtgtgcaccttccagga

SEQ ID NO: 119010 - DNA, 25 bp, mus musculus
tcgtgtgcaccttccaggagtatgc

SEQ ID NO: 119011 - DNA, 25 bp, mus musculus
tgtgcaccttccaggagtatgcagg

SEQ ID NO: 119012 - DNA, 25 bp, mus musculus
gcaccttccaggagtatgcagggcg

SEQ ID NO: 119013 - DNA, 25 bp, mus musculus
atgcagggcgctgtggggataaata

SEQ ID NO: 119014 - DNA, 25 bp, mus musculus
tttcctggctggaggccaaccagct

SEQ ID NO: 119015 - DNA, 25 bp, mus musculus
aggccaaccagctggctgagaaaga

SEQ ID NO: 119016 - DNA, 25 bp, mus musculus
ttcttgaactgactggactcaagcc

SEQ ID NO: 119017 - DNA, 25 bp, mus musculus
aactgactggactcaagcctacgtc

SEQ ID NO: 119018 - DNA, 25 bp, mus musculus
ctggactcaagcctacgtcaccatc

SEQ ID NO: 119019 - DNA, 25 bp, mus musculus
tctcatctatgatcctgaactggac

SEQ ID NO: 119020 - DNA, 25 bp, mus musculus
ctatgatcctgaactggacctttag

SEQ ID NO: 119021 - DNA, 25 bp, mus musculus
ccctctttgagccatttgaagaatt

SEQ ID NO: 119022 - DNA, 25 bp, mus musculus
ggttatttgtctctcagtaaatttg

SEQ ID NO: 119023 - DNA, 25 bp, mus musculus
ttgtctctcagtaaatttgttccca

SEQ ID NO: 119024 - DNA, 25 bp, mus musculus
ttttagtcagggccttactgtatat

SEQ ID NO: 119025 - DNA, 25 bp, mus musculus
tcagggccttactgtatatgtctag

SEQ ID NO: 119026 - DNA, 25 bp, mus musculus
tgtgtaatccgatcatcacaaaact

SEQ ID NO: 119027 - DNA, 25 bp, mus musculus
cagggccttactgtatatgtctaga

SEQ ID NO: 119028 - DNA, 25 bp, mus musculus
atccgatcatcacaaaactgtacca

SEQ ID NO: 119029 - DNA, 25 bp, mus musculus
tcatcacaaaactgtaccagagcgg

SEQ ID NO: 119030 - DNA, 25 bp, mus musculus
cagggtatactcccggcagggctgc

SEQ ID NO: 119031 - DNA, 25 bp, mus musculus
tagattagccttttccagaattgca

SEQ ID NO: 119032 - DNA, 25 bp, mus musculus
agccttttccagaattgcagggtgc

SEQ ID NO: 119033 - DNA, 25 bp, mus musculus
aattgcagggtgctagggtgcctct

SEQ ID NO: 119034 - DNA, 25 bp, mus musculus
attcatcttcaaacatcaatatgat

SEQ ID NO: 119035 - DNA, 25 bp, mus musculus
aattgaaatcagcaccattgcaagc

SEQ ID NO: 119036 - DNA, 25 bp, mus musculus
tgaaatcagcaccattgcaagcaac

SEQ ID NO: 119037 - DNA, 25 bp, mus musculus
ccagtcacaacaacttgaaaccagc

SEQ ID NO: 119038 - DNA, 25 bp, mus musculus
acaacttgaaaccagctcacaaaga

SEQ ID NO: 119039 - DNA, 25 bp, mus musculus
acttgaaaccagctcacaaagagac

SEQ ID NO: 119040 - DNA, 25 bp, mus musculus
tgaaaccagctcacaaagagacttc

SEQ ID NO: 119041 - DNA, 25 bp, mus musculus
aaccagctcacaaagagacttcaaa

SEQ ID NO: 119042 - DNA, 25 bp, mus musculus
ggacaaactcacaaaggatgctcag

SEQ ID NO: 119043 - DNA, 25 bp, mus musculus
tcagcatgccttacgcagaactatg

SEQ ID NO: 119044 - DNA, 25 bp, mus musculus
gcatgccttacgcagaactatggag

SEQ ID NO: 119045 - DNA, 25 bp, mus musculus
tgccttacgcagaactatggagaaa

SEQ ID NO: 119046 - DNA, 25 bp, mus musculus
cttacgcagaactatggagaaatac

SEQ ID NO: 119047 - DNA, 25 bp, mus musculus
cagcaccattgcaagcaactaccac

SEQ ID NO: 119048 - DNA, 25 bp, mus musculus
cattgcaagcaactaccaccttgaa

SEQ ID NO: 119049 - DNA, 25 bp, mus musculus
tgcaagcaactaccaccttgaagtt

SEQ ID NO: 119050 - DNA, 25 bp, mus musculus
ccaccttgaagttaatcccagtgat

SEQ ID NO: 119051 - DNA, 25 bp, mus musculus
ccttgaagttaatcccagtgatgcg

SEQ ID NO: 119052 - DNA, 25 bp, mus musculus
taatcccagtgatgcggggaacagc

SEQ ID NO: 119053 - DNA, 25 bp, mus musculus
gaacagcgaccgagttgtaattcag

SEQ ID NO: 119054 - DNA, 25 bp, mus musculus
agtggcccagtcacaacaacttgaa

SEQ ID NO: 119055 - DNA, 25 bp, mus musculus
gcacgaggccacaaccaaagttatt

SEQ ID NO: 119056 - DNA, 25 bp, mus musculus
tattaccttaatggatgctccaggc

SEQ ID NO: 119057 - DNA, 25 bp, mus musculus
gatcacaggagcagcccaggccgat

SEQ ID NO: 119058 - DNA, 25 bp, mus musculus
cacaggagcagcccaggccgatgtc

SEQ ID NO: 119059 - DNA, 25 bp, mus musculus
tgatgccagcagaggagagtttgaa

SEQ ID NO: 119060 - DNA, 25 bp, mus musculus
ccgagagcatggccttttggtccga

SEQ ID NO: 119061 - DNA, 25 bp, mus musculus
agagcatggccttttggtccgatct

SEQ ID NO: 119062 - DNA, 25 bp, mus musculus
ggtccgatctcttggagtgacacag

SEQ ID NO: 119063 - DNA, 25 bp, mus musculus
atctcttggagtgacacagcttgct

SEQ ID NO: 119064 - DNA, 25 bp, mus musculus
agtgacacagcttgctgtggctgtc

SEQ ID NO: 119065 - DNA, 25 bp, mus musculus
acagcttgctgtggctgtcaataag

SEQ ID NO: 119066 - DNA, 25 bp, mus musculus
gcttgctgtggctgtcaataagatg

SEQ ID NO: 119067 - DNA, 25 bp, mus musculus
taccttaatggatgctccaggccat

SEQ ID NO: 119068 - DNA, 25 bp, mus musculus
aatggatgctccaggccataaggat

SEQ ID NO: 119069 - DNA, 25 bp, mus musculus
tgctccaggccataaggatttcatt

SEQ ID NO: 119070 - DNA, 25 bp, mus musculus
ggatttcattccaaacatgatcaca

SEQ ID NO: 119071 - DNA, 25 bp, mus musculus
tttcattccaaacatgatcacagga

SEQ ID NO: 119072 - DNA, 25 bp, mus musculus
cattccaaacatgatcacaggagca

SEQ ID NO: 119073 - DNA, 25 bp, mus musculus
tccaaacatgatcacaggagcagcc

SEQ ID NO: 119074 - DNA, 25 bp, mus musculus
catgatcacaggagcagcccaggcc

SEQ ID NO: 119075 - DNA, 25 bp, mus musculus
agcccagtgctgctgttcctgatga

SEQ ID NO: 119076 - DNA, 25 bp, mus musculus
ccagtgctgctgttcctgatgagat

SEQ ID NO: 119077 - DNA, 25 bp, mus musculus
gctctctgctcatgtctacaagaat

SEQ ID NO: 119078 - DNA, 25 bp, mus musculus
ctctgctcatgtctacaagaatctt

SEQ ID NO: 119079 - DNA, 25 bp, mus musculus
tgctcatgtctacaagaatcttcta

SEQ ID NO: 119080 - DNA, 25 bp, mus musculus
tgtctacaagaatcttctatcctgt

SEQ ID NO: 119081 - DNA, 25 bp, mus musculus
ctacaagaatcttctatcctgtcct

SEQ ID NO: 119082 - DNA, 25 bp, mus musculus
caagaatcttctatcctgtcctgtg

SEQ ID NO: 119083 - DNA, 25 bp, mus musculus
gaatcttctatcctgtcctgtgcct

SEQ ID NO: 119084 - DNA, 25 bp, mus musculus
tctatcctgtcctgtgccttaaggc

SEQ ID NO: 119085 - DNA, 25 bp, mus musculus
atcctgtcctgtgccttaaggcagg

SEQ ID NO: 119086 - DNA, 25 bp, mus musculus
tcctgtgccttaaggcaggaagatc

SEQ ID NO: 119087 - DNA, 25 bp, mus musculus
gtgctgctgttcctgatgagatccc

SEQ ID NO: 119088 - DNA, 25 bp, mus musculus
cccctctggaaggcgatgaggatgc

SEQ ID NO: 119089 - DNA, 25 bp, mus musculus
atgaggatgcctcgcgcatggaaga

SEQ ID NO: 119090 - DNA, 25 bp, mus musculus
aggatgcctcgcgcatggaagaggt

SEQ ID NO: 119091 - DNA, 25 bp, mus musculus
atgcctcgcgcatggaagaggtgga

SEQ ID NO: 119092 - DNA, 25 bp, mus musculus
tggattaaagcctcctggaagaagc

SEQ ID NO: 119093 - DNA, 25 bp, mus musculus
cctctgtatagtatccccgtggctc

SEQ ID NO: 119094 - DNA, 25 bp, mus musculus
ctggctctctgctcatgtctacaag

SEQ ID NO: 119095 - DNA, 25 bp, mus musculus
catcgatgccaatggcatcctcaat

SEQ ID NO: 119096 - DNA, 25 bp, mus musculus
tgccaatggcatcctcaatgtttct

SEQ ID NO: 119097 - DNA, 25 bp, mus musculus
tgaaatcatcagctggctggataag

SEQ ID NO: 119098 - DNA, 25 bp, mus musculus
gaaccagactgcagagaaggaagaa

SEQ ID NO: 119099 - DNA, 25 bp, mus musculus
atttgagcatcagcagaaagaactg

SEQ ID NO: 119100 - DNA, 25 bp, mus musculus
agtctgcaaccctatcattaccaag

SEQ ID NO: 119101 - DNA, 25 bp, mus musculus
caaccctatcattaccaagctgtac

SEQ ID NO: 119102 - DNA, 25 bp, mus musculus
tatcattaccaagctgtaccagagt

SEQ ID NO: 119103 - DNA, 25 bp, mus musculus
gctgtaccagagtgcaggtggcatg

SEQ ID NO: 119104 - DNA, 25 bp, mus musculus
tggcttcccaggtggaggagctccc

SEQ ID NO: 119105 - DNA, 25 bp, mus musculus
agctcccccatctggtggtgcttct

SEQ ID NO: 119106 - DNA, 25 bp, mus musculus
cccatctggtggtgcttcttcaggc

SEQ ID NO: 119107 - DNA, 25 bp, mus musculus
tggcatcctcaatgtttctgctgta

SEQ ID NO: 119108 - DNA, 25 bp, mus musculus
cctcaatgtttctgctgtagataag

SEQ ID NO: 119109 - DNA, 25 bp, mus musculus
caagatcaccatcaccaatgacaag

SEQ ID NO: 119110 - DNA, 25 bp, mus musculus
caccaatgacaagggccgcttgagt

SEQ ID NO: 119111 - DNA, 25 bp, mus musculus
tgacaagggccgcttgagtaaggaa

SEQ ID NO: 119112 - DNA, 25 bp, mus musculus
ggtttcctccaagaactcactggag

SEQ ID NO: 119113 - DNA, 25 bp, mus musculus
actggagtcctatgccttcaacatg

SEQ ID NO: 119114 - DNA, 25 bp, mus musculus
tgccttcaacatgaaagcaactgtg

SEQ ID NO: 119115 - DNA, 25 bp, mus musculus
caagggccgcttgagtaaggaagat

SEQ ID NO: 119116 - DNA, 25 bp, mus musculus
atgccttcaacatgaaagcaactgt

SEQ ID NO: 119117 - DNA, 25 bp, mus musculus
tgccttcaacatgaaagcaactgtg

SEQ ID NO: 119118 - DNA, 25 bp, mus musculus
gccttcaacatgaaagcaactgtgg

SEQ ID NO: 119119 - DNA, 25 bp, mus musculus
ccttcaacatgaaagcaactgtgga

SEQ ID NO: 119120 - DNA, 25 bp, mus musculus
cttcaacatgaaagcaactgtggaa

SEQ ID NO: 119121 - DNA, 25 bp, mus musculus
attaagtcagtccaagaagaaggtg

SEQ ID NO: 119122 - DNA, 25 bp, mus musculus
caagggccgcttgagtaaggaagat

SEQ ID NO: 119123 - DNA, 25 bp, mus musculus
atgccttcaacatgaaagcaactgt

SEQ ID NO: 119124 - DNA, 25 bp, mus musculus
tgccttcaacatgaaagcaactgtg

SEQ ID NO: 119125 - DNA, 25 bp, mus musculus
gccttcaacatgaaagcaactgtgg

SEQ ID NO: 119126 - DNA, 25 bp, mus musculus
ccttcaacatgaaagcaactgtgga

SEQ ID NO: 119127 - DNA, 25 bp, mus musculus
cttcaacatgaaagcaactgtggaa

SEQ ID NO: 119128 - DNA, 25 bp, mus musculus
attcttgacaagtgcaatgaaatca

SEQ ID NO: 119129 - DNA, 25 bp, mus musculus
attaagtcagtccaagaagaaggtg

SEQ ID NO: 119130 - DNA, 25 bp, mus musculus
ctgcatggtcactgggagcaagtac

SEQ ID NO: 119131 - DNA, 25 bp, mus musculus
gtacacagagttcaactcttccaca

SEQ ID NO: 119132 - DNA, 25 bp, mus musculus
gtcctcagaatcagggatgtgaagg

SEQ ID NO: 119133 - DNA, 25 bp, mus musculus
aaggacagcagcacatactcacggc

SEQ ID NO: 119134 - DNA, 25 bp, mus musculus
gacagcagcacatactcacggctgt

SEQ ID NO: 119135 - DNA, 25 bp, mus musculus
agcacatactcacggctgtcattct

SEQ ID NO: 119136 - DNA, 25 bp, mus musculus
tactcacggctgtcattctgccttc

SEQ ID NO: 119137 - DNA, 25 bp, mus musculus
ctgtcattctgccttctgttcctgc

SEQ ID NO: 119138 - DNA, 25 bp, mus musculus
tgccttctgttcctgccacctttcg

SEQ ID NO: 119139 - DNA, 25 bp, mus musculus
tgaccccacttcatataaagaaggg

SEQ ID NO: 119140 - DNA, 25 bp, mus musculus
ccagcaatgagccctgccacggggc

SEQ ID NO: 119141 - DNA, 25 bp, mus musculus
gcaatgagccctgccacggggcaag

SEQ ID NO: 119142 - DNA, 25 bp, mus musculus
gttcaactcttccacaacaggcact

SEQ ID NO: 119143 - DNA, 25 bp, mus musculus
caactcttccacaacaggcactggc

SEQ ID NO: 119144 - DNA, 25 bp, mus musculus
cacaacaggcactggcaccagccaa

SEQ ID NO: 119145 - DNA, 25 bp, mus musculus
aacaggcactggcaccagccaaaca

SEQ ID NO: 119146 - DNA, 25 bp, mus musculus
aggcactggcaccagccaaacacgg

SEQ ID NO: 119147 - DNA, 25 bp, mus musculus
caccagccaaacacgggctctcagg

SEQ ID NO: 119148 - DNA, 25 bp, mus musculus
ggctctcaggtcctcagaatcaggg

SEQ ID NO: 119149 - DNA, 25 bp, mus musculus
caggtcctcagaatcagggatgtga

SEQ ID NO: 119150 - DNA, 25 bp, mus musculus
agaccctgggctgtacctctgtcat

SEQ ID NO: 119151 - DNA, 25 bp, mus musculus
ctgtcatctgttctgacaaaacagg

SEQ ID NO: 119152 - DNA, 25 bp, mus musculus
gagttctccatcactggctctactt

SEQ ID NO: 119153 - DNA, 25 bp, mus musculus
gttctccatcactggctctacttat

SEQ ID NO: 119154 - DNA, 25 bp, mus musculus
tccatcactggctctacttatgctc

SEQ ID NO: 119155 - DNA, 25 bp, mus musculus
tcactggctctacttatgctcctga

SEQ ID NO: 119156 - DNA, 25 bp, mus musculus
actggctctacttatgctcctgagg

SEQ ID NO: 119157 - DNA, 25 bp, mus musculus
gaatgataagccagtccgagcaggg

SEQ ID NO: 119158 - DNA, 25 bp, mus musculus
atgataagccagtccgagcagggca

SEQ ID NO: 119159 - DNA, 25 bp, mus musculus
taagccagtccgagcagggcagtat

SEQ ID NO: 119160 - DNA, 25 bp, mus musculus
agccagtccgagcagggcagtatga

SEQ ID NO: 119161 - DNA, 25 bp, mus musculus
ccagtccgagcagggcagtatgatg

SEQ ID NO: 119162 - DNA, 25 bp, mus musculus
ccaaccagatgtcagtttgcaagat

SEQ ID NO: 119163 - DNA, 25 bp, mus musculus
tgttcatcattgacaaggtggatgg

SEQ ID NO: 119164 - DNA, 25 bp, mus musculus
gatgtctgctcactgaacgagttct

SEQ ID NO: 119165 - DNA, 25 bp, mus musculus
tctgctcactgaacgagttctccat

SEQ ID NO: 119166 - DNA, 25 bp, mus musculus
tgctcactgaacgagttctccatca

SEQ ID NO: 119167 - DNA, 25 bp, mus musculus
ctcactgaacgagttctccatcact

SEQ ID NO: 119168 - DNA, 25 bp, mus musculus
cactgaacgagttctccatcactgg

SEQ ID NO: 119169 - DNA, 25 bp, mus musculus
gaacgagttctccatcactggctct

SEQ ID NO: 119170 - DNA, 25 bp, mus musculus
tttgagctggtcctgcgacaatttc

SEQ ID NO: 119171 - DNA, 25 bp, mus musculus
agctggtcctgcgacaatttcggtc

SEQ ID NO: 119172 - DNA, 25 bp, mus musculus
cacattggctatgcatggaacccta

SEQ ID NO: 119173 - DNA, 25 bp, mus musculus
atgcatggaaccctactcatgagca

SEQ ID NO: 119174 - DNA, 25 bp, mus musculus
atggaaccctactcatgagcaacaa

SEQ ID NO: 119175 - DNA, 25 bp, mus musculus
ggaaccctactcatgagcaacaaat

SEQ ID NO: 119176 - DNA, 25 bp, mus musculus
aaccctactcatgagcaacaaatct

SEQ ID NO: 119177 - DNA, 25 bp, mus musculus
atgagcaacaaatcttctcgtacgc

SEQ ID NO: 119178 - DNA, 25 bp, mus musculus
gagcaacaaatcttctcgtacgcaa

SEQ ID NO: 119179 - DNA, 25 bp, mus musculus
caaatcttctcgtacgcaattctgg

SEQ ID NO: 119180 - DNA, 25 bp, mus musculus
aatcttctcgtacgcaattctggat

SEQ ID NO: 119181 - DNA, 25 bp, mus musculus
tcttctcgtacgcaattctggattt

SEQ ID NO: 119182 - DNA, 25 bp, mus musculus
ggtcctgcgacaatttcggtcgatg

SEQ ID NO: 119183 - DNA, 25 bp, mus musculus
ttctcgtacgcaattctggatttgc

SEQ ID NO: 119184 - DNA, 25 bp, mus musculus
gcgacaatttcggtcgatggctctg

SEQ ID NO: 119185 - DNA, 25 bp, mus musculus
gacaatttcggtcgatggctctggg

SEQ ID NO: 119186 - DNA, 25 bp, mus musculus
caatttcggtcgatggctctggggc

SEQ ID NO: 119187 - DNA, 25 bp, mus musculus
tattgggagtctcacattggctatg

SEQ ID NO: 119188 - DNA, 25 bp, mus musculus
gagtctcacattggctatgcatgga

SEQ ID NO: 119189 - DNA, 25 bp, mus musculus
gtctcacattggctatgcatggaac

SEQ ID NO: 119190 - DNA, 25 bp, mus musculus
ctcacattggctatgcatggaaccc

SEQ ID NO: 119191 - DNA, 25 bp, mus musculus
accatgaactcgtcttctgagcatt

SEQ ID NO: 119192 - DNA, 25 bp, mus musculus
aactcgtcttctgagcattgcaaca

SEQ ID NO: 119193 - DNA, 25 bp, mus musculus
gggctccacaacagagatctgcaga

SEQ ID NO: 119194 - DNA, 25 bp, mus musculus
agcaaactgtacccttggctgtgct

SEQ ID NO: 119195 - DNA, 25 bp, mus musculus
ataactccagacttaatgggtgtgc

SEQ ID NO: 119196 - DNA, 25 bp, mus musculus
tgccttgatttggttttgaaagcac

SEQ ID NO: 119197 - DNA, 25 bp, mus musculus
ctgtagacttctctgctgtacctca

SEQ ID NO: 119198 - DNA, 25 bp, mus musculus
acttctctgctgtacctcactaaga

SEQ ID NO: 119199 - DNA, 25 bp, mus musculus
ctgctgtacctcactaagactagct

SEQ ID NO: 119200 - DNA, 25 bp, mus musculus
tacctcactaagactagctagtgct

SEQ ID NO: 119201 - DNA, 25 bp, mus musculus
ttttaactctaaacccagatgagca

SEQ ID NO: 119202 - DNA, 25 bp, mus musculus
ctctaaacccagatgagcaaaatat

SEQ ID NO: 119203 - DNA, 25 bp, mus musculus
atatctgactggctgagactagagg

SEQ ID NO: 119204 - DNA, 25 bp, mus musculus
gctttctcaatcaccacatctctca

SEQ ID NO: 119205 - DNA, 25 bp, mus musculus
atcgcaatagtgtcacagagtctgc

SEQ ID NO: 119206 - DNA, 25 bp, mus musculus
atagtgtcacagagtctgcagctga

SEQ ID NO: 119207 - DNA, 25 bp, mus musculus
agtctgcagctgaggaaagagtgtt

SEQ ID NO: 119208 - DNA, 25 bp, mus musculus
gagtgtttcaaccctttcgtctatg

SEQ ID NO: 119209 - DNA, 25 bp, mus musculus
cctttcgtctatgggctccacaaca

SEQ ID NO: 119210 - DNA, 25 bp, mus musculus
gtctatgggctccacaacagagatc

SEQ ID NO: 119211 - DNA, 25 bp, mus musculus
ttcggatccatgcaagcaatgcagc

SEQ ID NO: 119212 - DNA, 25 bp, mus musculus
ggatccatgcaagcaatgcagcccg

SEQ ID NO: 119213 - DNA, 25 bp, mus musculus
ctccttctagcaagtgaagattctc

SEQ ID NO: 119214 - DNA, 25 bp, mus musculus
gaagattctctgagggcgagagtcg

SEQ ID NO: 119215 - DNA, 25 bp, mus musculus
gattctctgagggcgagagtcgacg

SEQ ID NO: 119216 - DNA, 25 bp, mus musculus
gaactcattattgctcatggacggg

SEQ ID NO: 119217 - DNA, 25 bp, mus musculus
attgctcatggacgggaaaatggag

SEQ ID NO: 119218 - DNA, 25 bp, mus musculus
ttggacctcggattattagactctt

SEQ ID NO: 119219 - DNA, 25 bp, mus musculus
ttagactcttcagaaaaggtacagg

SEQ ID NO: 119220 - DNA, 25 bp, mus musculus
aacagaaagcgccatggctctagta

SEQ ID NO: 119221 - DNA, 25 bp, mus musculus
aagcgccatggctctagtagaagtg

SEQ ID NO: 119222 - DNA, 25 bp, mus musculus
cgccatggctctagtagaagtgtag

SEQ ID NO: 119223 - DNA, 25 bp, mus musculus
tccatgcaagcaatgcagcccgcat

SEQ ID NO: 119224 - DNA, 25 bp, mus musculus
atgcaagcaatgcagcccgcatttg

SEQ ID NO: 119225 - DNA, 25 bp, mus musculus
cagcccgcatttgcaagtaaaatca

SEQ ID NO: 119226 - DNA, 25 bp, mus musculus
gagttatccccagctcagctgcttc

SEQ ID NO: 119227 - DNA, 25 bp, mus musculus
ccagctcagctgcttctccttctag

SEQ ID NO: 119228 - DNA, 25 bp, mus musculus
gctcagctgcttctccttctagcaa

SEQ ID NO: 119229 - DNA, 25 bp, mus musculus
ctgcttctccttctagcaagtgaag

SEQ ID NO: 119230 - DNA, 25 bp, mus musculus
cttctccttctagcaagtgaagatt

SEQ ID NO: 119231 - DNA, 25 bp, mus musculus
aggagaccaacgagctcatgctctc

SEQ ID NO: 119232 - DNA, 25 bp, mus musculus
agaccaacgagctcatgctctccat

SEQ ID NO: 119233 - DNA, 25 bp, mus musculus
tggttgccacacagcattgtaccca

SEQ ID NO: 119234 - DNA, 25 bp, mus musculus
ttgccacacagcattgtacccagag

SEQ ID NO: 119235 - DNA, 25 bp, mus musculus
ccacacagcattgtacccagagtct

SEQ ID NO: 119236 - DNA, 25 bp, mus musculus
agcattgtacccagagtctgtcccc

SEQ ID NO: 119237 - DNA, 25 bp, mus musculus
attgtacccagagtctgtccccaga

SEQ ID NO: 119238 - DNA, 25 bp, mus musculus
gtacccagagtctgtccccagacat

SEQ ID NO: 119239 - DNA, 25 bp, mus musculus
agagtctgtccccagacattgcacc

SEQ ID NO: 119240 - DNA, 25 bp, mus musculus
tgtccccagacattgcacctggcgc

SEQ ID NO: 119241 - DNA, 25 bp, mus musculus
cagacattgcacctggcgctgttag

SEQ ID NO: 119242 - DNA, 25 bp, mus musculus
acattgcacctggcgctgttagatt

SEQ ID NO: 119243 - DNA, 25 bp, mus musculus
ccaacgagctcatgctctccatgct

SEQ ID NO: 119244 - DNA, 25 bp, mus musculus
tcatgctctccatgctcttcaacca

SEQ ID NO: 119245 - DNA, 25 bp, mus musculus
tgctctccatgctcttcaaccagtt

SEQ ID NO: 119246 - DNA, 25 bp, mus musculus
tgaagatctcttttgccaagaagta

SEQ ID NO: 119247 - DNA, 25 bp, mus musculus
tctcttttgccaagaagtagcgcct

SEQ ID NO: 119248 - DNA, 25 bp, mus musculus
agaagtagcgcctttccctatggag

SEQ ID NO: 119249 - DNA, 25 bp, mus musculus
ccttggctcagtccctgaaggtaag

SEQ ID NO: 119250 - DNA, 25 bp, mus musculus
cttagggaccttctcagagccgtgt

SEQ ID NO: 119251 - DNA, 25 bp, mus musculus
agattctcgctctgctcattcacac

SEQ ID NO: 119252 - DNA, 25 bp, mus musculus
tcgctctgctcattcacacacgtaa

SEQ ID NO: 119253 - DNA, 25 bp, mus musculus
aattctgattcttatgtcaagcaaa

SEQ ID NO: 119254 - DNA, 25 bp, mus musculus
tacctaattccaagactatactggg

SEQ ID NO: 119255 - DNA, 25 bp, mus musculus
cagagttatttcccaatccaggatt

SEQ ID NO: 119256 - DNA, 25 bp, mus musculus
tatttcccaatccaggattcaatat

SEQ ID NO: 119257 - DNA, 25 bp, mus musculus
tgtgctacacacaaagtgaaatttg

SEQ ID NO: 119258 - DNA, 25 bp, mus musculus
aaatttgcatgttgagccttattaa

SEQ ID NO: 119259 - DNA, 25 bp, mus musculus
cttaattatggtacctcgatctata

SEQ ID NO: 119260 - DNA, 25 bp, mus musculus
tatggtacctcgatctataggaccc

SEQ ID NO: 119261 - DNA, 25 bp, mus musculus
atctataggacccaatttagcagtc

SEQ ID NO: 119262 - DNA, 25 bp, mus musculus
tataggacccaatttagcagtccgt

SEQ ID NO: 119263 - DNA, 25 bp, mus musculus
tggttctgcccattgtgaaacatat

SEQ ID NO: 119264 - DNA, 25 bp, mus musculus
aacatattcatcagtgagtcagaga

SEQ ID NO: 119265 - DNA, 25 bp, mus musculus
ttgctgcaatgtctgtccccaaaca

SEQ ID NO: 119266 - DNA, 25 bp, mus musculus
caatgtctgtccccaaacatagtgg

SEQ ID NO: 119267 - DNA, 25 bp, mus musculus
atacacaccaaacagcttttcactt

SEQ ID NO: 119268 - DNA, 25 bp, mus musculus
cagcttttcacttcttaaggacaat

SEQ ID NO: 119269 - DNA, 25 bp, mus musculus
ttcacttcttaaggacaatgttcaa

SEQ ID NO: 119270 - DNA, 25 bp, mus musculus
tgttcaaattctgattcttatgtca

SEQ ID NO: 119271 - DNA, 25 bp, mus musculus
accagattgctactcgtctgcggta

SEQ ID NO: 119272 - DNA, 25 bp, mus musculus
agattgctactcgtctgcggtatgg

SEQ ID NO: 119273 - DNA, 25 bp, mus musculus
tcatgtacctggtgacagacctgct

SEQ ID NO: 119274 - DNA, 25 bp, mus musculus
tgacagacctgctgtggtacacccc

SEQ ID NO: 119275 - DNA, 25 bp, mus musculus
cgctcatccatgtgattctacttca

SEQ ID NO: 119276 - DNA, 25 bp, mus musculus
tcatccatgtgattctacttcacaa

SEQ ID NO: 119277 - DNA, 25 bp, mus musculus
tccatgtgattctacttcacaaatc

SEQ ID NO: 119278 - DNA, 25 bp, mus musculus
atgtgattctacttcacaaatcatt

SEQ ID NO: 119279 - DNA, 25 bp, mus musculus
tgattctacttcacaaatcattctc

SEQ ID NO: 119280 - DNA, 25 bp, mus musculus
ttctacttcacaaatcattctcaga

SEQ ID NO: 119281 - DNA, 25 bp, mus musculus
tacttcacaaatcattctcagagct

SEQ ID NO: 119282 - DNA, 25 bp, mus musculus
ttcacaaatcattctcagagctcct

SEQ ID NO: 119283 - DNA, 25 bp, mus musculus
ttgctactcgtctgcggtatggtga

SEQ ID NO: 119284 - DNA, 25 bp, mus musculus
ctactcgtctgcggtatggtgagca

SEQ ID NO: 119285 - DNA, 25 bp, mus musculus
atggtgagcacctgaacttgatcaa

SEQ ID NO: 119286 - DNA, 25 bp, mus musculus
agcacctgaacttgatcaacctgaa

SEQ ID NO: 119287 - DNA, 25 bp, mus musculus
acctgaacttgatcaacctgaaaga

SEQ ID NO: 119288 - DNA, 25 bp, mus musculus
tgaacttgatcaacctgaaagatgc

SEQ ID NO: 119289 - DNA, 25 bp, mus musculus
acttgatcaacctgaaagatgccta

SEQ ID NO: 119290 - DNA, 25 bp, mus musculus
acctcatgtacctggtgacagacct

SEQ ID NO: 119291 - DNA, 25 bp, mus musculus
ccttctgaggtagcctggagagagc

SEQ ID NO: 119292 - DNA, 25 bp, mus musculus
tgttttctctctgctctgaggtcca

SEQ ID NO: 119293 - DNA, 25 bp, mus musculus
cactggcctaacagaagtcctcttg

SEQ ID NO: 119294 - DNA, 25 bp, mus musculus
cctaacagaagtcctcttgctcctt

SEQ ID NO: 119295 - DNA, 25 bp, mus musculus
cctcttgctccttgaagggctctta

SEQ ID NO: 119296 - DNA, 25 bp, mus musculus
gaggactatttccaagcctgtgaca

SEQ ID NO: 119297 - DNA, 25 bp, mus musculus
tatttccaagcctgtgacaccgtgc

SEQ ID NO: 119298 - DNA, 25 bp, mus musculus
tgtgacaccgtgcaagagacggtcg

SEQ ID NO: 119299 - DNA, 25 bp, mus musculus
gaactactgcgcagggtccatggag

SEQ ID NO: 119300 - DNA, 25 bp, mus musculus
aggaactgcatgcagcattgtgagc

SEQ ID NO: 119301 - DNA, 25 bp, mus musculus
tgcatgcagcattgtgagctcagag

SEQ ID NO: 119302 - DNA, 25 bp, mus musculus
tgtgagctcagagctggtgtcctgg

SEQ ID NO: 119303 - DNA, 25 bp, mus musculus
aggtccatgggctggaatggagaca

SEQ ID NO: 119304 - DNA, 25 bp, mus musculus
gtttgtttccagccctgcttcacat

SEQ ID NO: 119305 - DNA, 25 bp, mus musculus
ccctgcttcacattccctctgagtg

SEQ ID NO: 119306 - DNA, 25 bp, mus musculus
ttcacattccctctgagtgtcctct

SEQ ID NO: 119307 - DNA, 25 bp, mus musculus
gtcctctgcgtactgagactagatg

SEQ ID NO: 119308 - DNA, 25 bp, mus musculus
gctacccaatgacgggacaggttgt

SEQ ID NO: 119309 - DNA, 25 bp, mus musculus
aggttgtgtctcatactcttgcatg

SEQ ID NO: 119310 - DNA, 25 bp, mus musculus
ccacgtttgtgcagatttggagcca

SEQ ID NO: 119311 - DNA, 25 bp, mus musculus
tgaatggtctggtctctgtgagaaa

SEQ ID NO: 119312 - DNA, 25 bp, mus musculus
agttccacctcgcaatagtagatac

SEQ ID NO: 119313 - DNA, 25 bp, mus musculus
acttctatcagggcacagaaaacac

SEQ ID NO: 119314 - DNA, 25 bp, mus musculus
acaccttcatcctgtcatagctcat

SEQ ID NO: 119315 - DNA, 25 bp, mus musculus
ccttcatcctgtcatagctcattaa

SEQ ID NO: 119316 - DNA, 25 bp, mus musculus
ttaaatcagatccaccaagtaagac

SEQ ID NO: 119317 - DNA, 25 bp, mus musculus
aatcagatccaccaagtaagactat

SEQ ID NO: 119318 - DNA, 25 bp, mus musculus
atccaccaagtaagactatagaata

SEQ ID NO: 119319 - DNA, 25 bp, mus musculus
aatttgcctgttgtatattatgtag

SEQ ID NO: 119320 - DNA, 25 bp, mus musculus
ttcaaaaatcatctgtgcattccct

SEQ ID NO: 119321 - DNA, 25 bp, mus musculus
catctgtgcattccctgtaggaaaa

SEQ ID NO: 119322 - DNA, 25 bp, mus musculus
tgcattccctgtaggaaaataatca

SEQ ID NO: 119323 - DNA, 25 bp, mus musculus
agaagcccactgatggcgacaagtc

SEQ ID NO: 119324 - DNA, 25 bp, mus musculus
aagagccctcaaatgtggaaagcag

SEQ ID NO: 119325 - DNA, 25 bp, mus musculus
gtacgaatcccatgactttcctaag

SEQ ID NO: 119326 - DNA, 25 bp, mus musculus
aagctcttctgagttggccttagtg

SEQ ID NO: 119327 - DNA, 25 bp, mus musculus
ttctgagttggccttagtgtagcaa

SEQ ID NO: 119328 - DNA, 25 bp, mus musculus
tgagttggccttagtgtagcaagct

SEQ ID NO: 119329 - DNA, 25 bp, mus musculus
gtagcaagctccacttctatcaggg

SEQ ID NO: 119330 - DNA, 25 bp, mus musculus
agctccacttctatcagggcacaga

SEQ ID NO: 119331 - DNA, 25 bp, mus musculus
ggttctaaccatggctgcgagcgcc

SEQ ID NO: 119332 - DNA, 25 bp, mus musculus
gttctaaccatggctgcgagcgcca

SEQ ID NO: 119333 - DNA, 25 bp, mus musculus
cgtgctgacggtggactctgaaccg

SEQ ID NO: 119334 - DNA, 25 bp, mus musculus
tgctgacggtggactctgaaccggc

SEQ ID NO: 119335 - DNA, 25 bp, mus musculus
gctggacaaacccgagaccgacctg

SEQ ID NO: 119336 - DNA, 25 bp, mus musculus
tggacaaacccgagaccgacctgct

SEQ ID NO: 119337 - DNA, 25 bp, mus musculus
gacaaacccgagaccgacctgctca

SEQ ID NO: 119338 - DNA, 25 bp, mus musculus
acctggatcgctgcgtggccttcat

SEQ ID NO: 119339 - DNA, 25 bp, mus musculus
cctggatcgctgcgtggccttcatc

SEQ ID NO: 119340 - DNA, 25 bp, mus musculus
ctggatcgctgcgtggccttcatcg

SEQ ID NO: 119341 - DNA, 25 bp, mus musculus
gatcgctgcgtggccttcatcggcc

SEQ ID NO: 119342 - DNA, 25 bp, mus musculus
atcgctgcgtggccttcatcggcca

SEQ ID NO: 119343 - DNA, 25 bp, mus musculus
tctaaccatggctgcgagcgccagg

SEQ ID NO: 119344 - DNA, 25 bp, mus musculus
ctaaccatggctgcgagcgccaggc

SEQ ID NO: 119345 - DNA, 25 bp, mus musculus
ccatggctgcgagcgccaggctccg

SEQ ID NO: 119346 - DNA, 25 bp, mus musculus
cgagcgccaggctccgactgccagt

SEQ ID NO: 119347 - DNA, 25 bp, mus musculus
cgccagctcggcagggcacgccgtg

SEQ ID NO: 119348 - DNA, 25 bp, mus musculus
cgggcatcaccgccgtgctgacggt

SEQ ID NO: 119349 - DNA, 25 bp, mus musculus
caccgccgtgctgacggtggactct

SEQ ID NO: 119350 - DNA, 25 bp, mus musculus
ccgtgctgacggtggactctgaacc

SEQ ID NO: 119351 - DNA, 25 bp, mus musculus
aagcgagacctgctcttccaagccc

SEQ ID NO: 119352 - DNA, 25 bp, mus musculus
tgctcttccaagccctgggccggac

SEQ ID NO: 119353 - DNA, 25 bp, mus musculus
caagattgacgtccctgccaacaga

SEQ ID NO: 119354 - DNA, 25 bp, mus musculus
attgacgtccctgccaacagatacg

SEQ ID NO: 119355 - DNA, 25 bp, mus musculus
tgacgtccctgccaacagatacgac

SEQ ID NO: 119356 - DNA, 25 bp, mus musculus
acgtccctgccaacagatacgacct

SEQ ID NO: 119357 - DNA, 25 bp, mus musculus
ctgccaacagatacgacctcctgtg

SEQ ID NO: 119358 - DNA, 25 bp, mus musculus
caacagatacgacctcctgtgtctg

SEQ ID NO: 119359 - DNA, 25 bp, mus musculus
acagatacgacctcctgtgtctgga

SEQ ID NO: 119360 - DNA, 25 bp, mus musculus
aaggatcaaagctccggtatataag

SEQ ID NO: 119361 - DNA, 25 bp, mus musculus
ggatcaaagctccggtatataagcg

SEQ ID NO: 119362 - DNA, 25 bp, mus musculus
caaagctccggtatataagcgagtg

SEQ ID NO: 119363 - DNA, 25 bp, mus musculus
agccctgggccggacctacactgat

SEQ ID NO: 119364 - DNA, 25 bp, mus musculus
gggccggacctacactgatgaagag

SEQ ID NO: 119365 - DNA, 25 bp, mus musculus
gccggacctacactgatgaagagtt

SEQ ID NO: 119366 - DNA, 25 bp, mus musculus
cggacctacactgatgaagagtttg

SEQ ID NO: 119367 - DNA, 25 bp, mus musculus
tgaatttggtctggaacttgatgaa

SEQ ID NO: 119368 - DNA, 25 bp, mus musculus
aaggcacagggggcctcagatgttg

SEQ ID NO: 119369 - DNA, 25 bp, mus musculus
tttacaagattgacgtccctgccaa

SEQ ID NO: 119370 - DNA, 25 bp, mus musculus
tacaagattgacgtccctgccaaca

SEQ ID NO: 119371 - DNA, 25 bp, mus musculus
agctcactagtgaacgcgacactct

SEQ ID NO: 119372 - DNA, 25 bp, mus musculus
ctagtgaacgcgacactctgaccat

SEQ ID NO: 119373 - DNA, 25 bp, mus musculus
cgtaccgcaggcaggctgctgtgcc

SEQ ID NO: 119374 - DNA, 25 bp, mus musculus
gtggcccgcaggcgcacttggtgca

SEQ ID NO: 119375 - DNA, 25 bp, mus musculus
actacatcgcgcacgtcatggcctc

SEQ ID NO: 119376 - DNA, 25 bp, mus musculus
tcgcgcacgtcatggcctctgcagg

SEQ ID NO: 119377 - DNA, 25 bp, mus musculus
cccctgcagatgaaagccagaccac

SEQ ID NO: 119378 - DNA, 25 bp, mus musculus
ccccggtccataacagcgccagaag

SEQ ID NO: 119379 - DNA, 25 bp, mus musculus
tccataacagcgccagaagcctggg

SEQ ID NO: 119380 - DNA, 25 bp, mus musculus
acagcgccagaagcctgggcccagc

SEQ ID NO: 119381 - DNA, 25 bp, mus musculus
tgctgatgctactactaggggctcc

SEQ ID NO: 119382 - DNA, 25 bp, mus musculus
tgctactactaggggctcctgcgga

SEQ ID NO: 119383 - DNA, 25 bp, mus musculus
aacgcgacactctgaccatagtcac

SEQ ID NO: 119384 - DNA, 25 bp, mus musculus
acactctgaccatagtcactgctga

SEQ ID NO: 119385 - DNA, 25 bp, mus musculus
tgaccatagtcactgctgaccactc

SEQ ID NO: 119386 - DNA, 25 bp, mus musculus
cctttggtggctacacacttcgagg

SEQ ID NO: 119387 - DNA, 25 bp, mus musculus
acacacttcgagggacctccatctt

SEQ ID NO: 119388 - DNA, 25 bp, mus musculus
atgctctggacggcaagccctacac

SEQ ID NO: 119389 - DNA, 25 bp, mus musculus
caggctatgtcggtacaggggaaag

SEQ ID NO: 119390 - DNA, 25 bp, mus musculus
acgtcaccgccgctgaaagcagtgg

SEQ ID NO: 119391 - DNA, 25 bp, mus musculus
aatccacccagggggcaatagccat

SEQ ID NO: 119392 - DNA, 25 bp, mus musculus
ccacccagggggcaatagccatatt

SEQ ID NO: 119393 - DNA, 25 bp, mus musculus
ccaccgcgtgacagactgtgttcgg

SEQ ID NO: 119394 - DNA, 25 bp, mus musculus
cgtgacagactgtgttcgggcagtg

SEQ ID NO: 119395 - DNA, 25 bp, mus musculus
agactgtgttcgggcagtgtggcaa

SEQ ID NO: 119396 - DNA, 25 bp, mus musculus
ctgtgttcgggcagtgtggcaaaat

SEQ ID NO: 119397 - DNA, 25 bp, mus musculus
tgttcgggcagtgtggcaaaatgaa

SEQ ID NO: 119398 - DNA, 25 bp, mus musculus
cttttaccgcagctacacgacccag

SEQ ID NO: 119399 - DNA, 25 bp, mus musculus
ctacacgacccagctgaccatgaat

SEQ ID NO: 119400 - DNA, 25 bp, mus musculus
cttccaagccattcacttcatgacc

SEQ ID NO: 119401 - DNA, 25 bp, mus musculus
ccaagccattcacttcatgacctat

SEQ ID NO: 119402 - DNA, 25 bp, mus musculus
agccattcacttcatgacctatgag

SEQ ID NO: 119403 - DNA, 25 bp, mus musculus
caatagccatattgccaatggtgca

SEQ ID NO: 119404 - DNA, 25 bp, mus musculus
tcacttcatgacctatgagttcctg

SEQ ID NO: 119405 - DNA, 25 bp, mus musculus
ccatattgccaatggtgcagccgga

SEQ ID NO: 119406 - DNA, 25 bp, mus musculus
tgcagccggatgtgtggcgacatta

SEQ ID NO: 119407 - DNA, 25 bp, mus musculus
tgtggcgacattacttcatgatgca

SEQ ID NO: 119408 - DNA, 25 bp, mus musculus
acttcatgatgcagccatgaatcca

SEQ ID NO: 119409 - DNA, 25 bp, mus musculus
tcatgatgcagccatgaatccagcg

SEQ ID NO: 119410 - DNA, 25 bp, mus musculus
gatgtacaactcgccgtaccaccgc

SEQ ID NO: 119411 - DNA, 25 bp, mus musculus
gccgtaccaccgcgtgacagactgt

SEQ ID NO: 119412 - DNA, 25 bp, mus musculus
atgatgtgcatctccaaactgccag

SEQ ID NO: 119413 - DNA, 25 bp, mus musculus
tgcatctccaaactgccagctgtcc

SEQ ID NO: 119414 - DNA, 25 bp, mus musculus
cgttccagcaacaaccttggtccag

SEQ ID NO: 119415 - DNA, 25 bp, mus musculus
agtcaatgtacttctgcagcactta

SEQ ID NO: 119416 - DNA, 25 bp, mus musculus
tgtacttctgcagcacttaatactt

SEQ ID NO: 119417 - DNA, 25 bp, mus musculus
tctgcagcacttaatactttatgtg

SEQ ID NO: 119418 - DNA, 25 bp, mus musculus
tgcttgatgactgtgtgtgtaaatt

SEQ ID NO: 119419 - DNA, 25 bp, mus musculus
aatgtctctaatcacacatgttctt

SEQ ID NO: 119420 - DNA, 25 bp, mus musculus
tctaatcacacatgttcttgctata

SEQ ID NO: 119421 - DNA, 25 bp, mus musculus
cacacatgttcttgctatacattta

SEQ ID NO: 119422 - DNA, 25 bp, mus musculus
ttaccttgtacctctatgactcaag

SEQ ID NO: 119423 - DNA, 25 bp, mus musculus
tgtacctctatgactcaagtttaac

SEQ ID NO: 119424 - DNA, 25 bp, mus musculus
atcctctctgtggcactgaaccact

SEQ ID NO: 119425 - DNA, 25 bp, mus musculus
tctgtggcactgaaccacttgagag

SEQ ID NO: 119426 - DNA, 25 bp, mus musculus
gcactgaaccacttgagagctacac

SEQ ID NO: 119427 - DNA, 25 bp, mus musculus
ggtagcaaccctcagatggacaaac

SEQ ID NO: 119428 - DNA, 25 bp, mus musculus
tgcaacacggccacgtgtgccacac

SEQ ID NO: 119429 - DNA, 25 bp, mus musculus
acgtgtgccacacaacgcctggcaa

SEQ ID NO: 119430 - DNA, 25 bp, mus musculus
gccacacaacgcctggcaaactttt

SEQ ID NO: 119431 - DNA, 25 bp, mus musculus
ttggttcgttccagcaacaaccttg

SEQ ID NO: 119432 - DNA, 25 bp, mus musculus
cagacagaccaacgtcgcagagcca

SEQ ID NO: 119433 - DNA, 25 bp, mus musculus
ctggaagtccagttctcccgcgttg

SEQ ID NO: 119434 - DNA, 25 bp, mus musculus
gcctcgtgtactcctgcagcacatt

SEQ ID NO: 119435 - DNA, 25 bp, mus musculus
gtatctccatgcagaaacaataact

SEQ ID NO: 119436 - DNA, 25 bp, mus musculus
atctccatgcagaaacaataactga

SEQ ID NO: 119437 - DNA, 25 bp, mus musculus
tctccatgcagaaacaataactgac

SEQ ID NO: 119438 - DNA, 25 bp, mus musculus
caataactgacccaagagatatcct

SEQ ID NO: 119439 - DNA, 25 bp, mus musculus
taactgacccaagagatatccttac

SEQ ID NO: 119440 - DNA, 25 bp, mus musculus
aactgacccaagagatatccttact

SEQ ID NO: 119441 - DNA, 25 bp, mus musculus
ctgacccaagagatatccttactgc

SEQ ID NO: 119442 - DNA, 25 bp, mus musculus
tgacccaagagatatccttactgct

SEQ ID NO: 119443 - DNA, 25 bp, mus musculus
tgctaatggcatcgacatcgacagc

SEQ ID NO: 119444 - DNA, 25 bp, mus musculus
ggaagtccagttctcccgcgttgat

SEQ ID NO: 119445 - DNA, 25 bp, mus musculus
gaagtccagttctcccgcgttgatg

SEQ ID NO: 119446 - DNA, 25 bp, mus musculus
agtccagttctcccgcgttgatgcc

SEQ ID NO: 119447 - DNA, 25 bp, mus musculus
gtccagttctcccgcgttgatgcca

SEQ ID NO: 119448 - DNA, 25 bp, mus musculus
ggcattctactagatcctggccacc

SEQ ID NO: 119449 - DNA, 25 bp, mus musculus
cattctactagatcctggccaccga

SEQ ID NO: 119450 - DNA, 25 bp, mus musculus
attctactagatcctggccaccgat

SEQ ID NO: 119451 - DNA, 25 bp, mus musculus
tggcctcgtgtactcctgcagcaca

SEQ ID NO: 119452 - DNA, 25 bp, mus musculus
atccagtagacacaagcaagaagac

SEQ ID NO: 119453 - DNA, 25 bp, mus musculus
acattgtcccaactcttcttgatgt

SEQ ID NO: 119454 - DNA, 25 bp, mus musculus
accagtcacataaacactatgtgga

SEQ ID NO: 119455 - DNA, 25 bp, mus musculus
aacactatgtggactggcagtggtt

SEQ ID NO: 119456 - DNA, 25 bp, mus musculus
ttttgttcccaatgtcagccaccat

SEQ ID NO: 119457 - DNA, 25 bp, mus musculus
tcccaatgtcagccaccatgcctta

SEQ ID NO: 119458 - DNA, 25 bp, mus musculus
tgtcagccaccatgccttagcagct

SEQ ID NO: 119459 - DNA, 25 bp, mus musculus
ccaccatgccttagcagctgaacaa

SEQ ID NO: 119460 - DNA, 25 bp, mus musculus
tgccttagcagctgaacaatcgagc

SEQ ID NO: 119461 - DNA, 25 bp, mus musculus
atcgagcctcatgctcatgaaatca

SEQ ID NO: 119462 - DNA, 25 bp, mus musculus
cctcatgctcatgaaatcatggtcc

SEQ ID NO: 119463 - DNA, 25 bp, mus musculus
gaaatcatggtcccaggcggctcca

SEQ ID NO: 119464 - DNA, 25 bp, mus musculus
tcccaactcttcttgatgtatttat

SEQ ID NO: 119465 - DNA, 25 bp, mus musculus
ttattgagtaccctgtatatagtag

SEQ ID NO: 119466 - DNA, 25 bp, mus musculus
agtaccctgtatatagtagatcagt

SEQ ID NO: 119467 - DNA, 25 bp, mus musculus
gaccctgctgcagatgctgtgagag

SEQ ID NO: 119468 - DNA, 25 bp, mus musculus
atcacatgggtcgagggtttctcta

SEQ ID NO: 119469 - DNA, 25 bp, mus musculus
ttctctactggtcaggatgcttttc

SEQ ID NO: 119470 - DNA, 25 bp, mus musculus
gcttttctcatataagggtcgactt

SEQ ID NO: 119471 - DNA, 25 bp, mus musculus
tttttcaccagtcacataaacacta

SEQ ID NO: 119472 - DNA, 25 bp, mus musculus
gggagaatctcatcctggctatgct

SEQ ID NO: 119473 - DNA, 25 bp, mus musculus
agaatctcatcctggctatgctcgg

SEQ ID NO: 119474 - DNA, 25 bp, mus musculus
gcgaccaagcaactacagcccgaat

SEQ ID NO: 119475 - DNA, 25 bp, mus musculus
accaagcaactacagcccgaatccg

SEQ ID NO: 119476 - DNA, 25 bp, mus musculus
ctacagcccgaatccgggatactct

SEQ ID NO: 119477 - DNA, 25 bp, mus musculus
cagcccgaatccgggatactcttcg

SEQ ID NO: 119478 - DNA, 25 bp, mus musculus
gggatactcttcggcgcgtgcttaa

SEQ ID NO: 119479 - DNA, 25 bp, mus musculus
atactcttcggcgcgtgcttaacct

SEQ ID NO: 119480 - DNA, 25 bp, mus musculus
ctcccaacaccattatggaatacaa

SEQ ID NO: 119481 - DNA, 25 bp, mus musculus
aatacaaaactcacaccgacagcat

SEQ ID NO: 119482 - DNA, 25 bp, mus musculus
aaactcacaccgacagcatcaaaat

SEQ ID NO: 119483 - DNA, 25 bp, mus musculus
ctcacaccgacagcatcaaaatgcc

SEQ ID NO: 119484 - DNA, 25 bp, mus musculus
atctcatcctggctatgctcgggga

SEQ ID NO: 119485 - DNA, 25 bp, mus musculus
acaccgacagcatcaaaatgccagg

SEQ ID NO: 119486 - DNA, 25 bp, mus musculus
tggctatgctcggggagcaattcat

SEQ ID NO: 119487 - DNA, 25 bp, mus musculus
ctatgctcggggagcaattcatggt

SEQ ID NO: 119488 - DNA, 25 bp, mus musculus
ctgtccgctttcaggaggacattat

SEQ ID NO: 119489 - DNA, 25 bp, mus musculus
tccgctttcaggaggacattatttc

SEQ ID NO: 119490 - DNA, 25 bp, mus musculus
ataagactgccagcgaccaagcaac

SEQ ID NO: 119491 - DNA, 25 bp, mus musculus
agactgccagcgaccaagcaactac

SEQ ID NO: 119492 - DNA, 25 bp, mus musculus
ctgccagcgaccaagcaactacagc

SEQ ID NO: 119493 - DNA, 25 bp, mus musculus
ataccagcagcgcgttgctcattac

SEQ ID NO: 119494 - DNA, 25 bp, mus musculus
cgttgctcattactcctgctctgaa

SEQ ID NO: 119495 - DNA, 25 bp, mus musculus
aagtcctatgtttgcagctgtcctg

SEQ ID NO: 119496 - DNA, 25 bp, mus musculus
tcctatgtttgcagctgtcctgaag

SEQ ID NO: 119497 - DNA, 25 bp, mus musculus
tatgtttgcagctgtcctgaagcag

SEQ ID NO: 119498 - DNA, 25 bp, mus musculus
gtttgcagctgtcctgaagcagatc

SEQ ID NO: 119499 - DNA, 25 bp, mus musculus
tgcagctgtcctgaagcagatcagc

SEQ ID NO: 119500 - DNA, 25 bp, mus musculus
tgtcctgaagcagatcagctctcca

SEQ ID NO: 119501 - DNA, 25 bp, mus musculus
cagctctccatgtggttcgacagga

SEQ ID NO: 119502 - DNA, 25 bp, mus musculus
ctctccatgtggttcgacaggaata

SEQ ID NO: 119503 - DNA, 25 bp, mus musculus
tccatgtggttcgacaggaatatca

SEQ ID NO: 119504 - DNA, 25 bp, mus musculus
aatagtgtcattacctggtatatcg

SEQ ID NO: 119505 - DNA, 25 bp, mus musculus
ttactcctgctctgaatcgctcatg

SEQ ID NO: 119506 - DNA, 25 bp, mus musculus
atagtgtcattacctggtatatcga

SEQ ID NO: 119507 - DNA, 25 bp, mus musculus
ctcctgctctgaatcgctcatgtac

SEQ ID NO: 119508 - DNA, 25 bp, mus musculus
ctgctctgaatcgctcatgtactag

SEQ ID NO: 119509 - DNA, 25 bp, mus musculus
tcctgatcagaccacaagtcctatg

SEQ ID NO: 119510 - DNA, 25 bp, mus musculus
tgatcagaccacaagtcctatgttt

SEQ ID NO: 119511 - DNA, 25 bp, mus musculus
tcagaccacaagtcctatgtttgca

SEQ ID NO: 119512 - DNA, 25 bp, mus musculus
gaccacaagtcctatgtttgcagct

SEQ ID NO: 119513 - DNA, 25 bp, mus musculus
cacaagtcctatgtttgcagctgtc

SEQ ID NO: 119514 - DNA, 25 bp, mus musculus
ctccggccttcgagtcgttcttgct

SEQ ID NO: 119515 - DNA, 25 bp, mus musculus
tgcttgttcaccatcaacaaagaag

SEQ ID NO: 119516 - DNA, 25 bp, mus musculus
gtgctgtttgctggctacaaagtcc

SEQ ID NO: 119517 - DNA, 25 bp, mus musculus
tgctgtttgctggctacaaagtccc

SEQ ID NO: 119518 - DNA, 25 bp, mus musculus
ctgtttgctggctacaaagtccctc

SEQ ID NO: 119519 - DNA, 25 bp, mus musculus
tgtttgctggctacaaagtccctca

SEQ ID NO: 119520 - DNA, 25 bp, mus musculus
agcacaagatcatcattcgtgtgca

SEQ ID NO: 119521 - DNA, 25 bp, mus musculus
cacaagatcatcattcgtgtgcaga

SEQ ID NO: 119522 - DNA, 25 bp, mus musculus
acaagatcatcattcgtgtgcagac

SEQ ID NO: 119523 - DNA, 25 bp, mus musculus
aagatcatcattcgtgtgcagacca

SEQ ID NO: 119524 - DNA, 25 bp, mus musculus
agatcatcattcgtgtgcagaccac

SEQ ID NO: 119525 - DNA, 25 bp, mus musculus
atcatcattcgtgtgcagaccaccc

SEQ ID NO: 119526 - DNA, 25 bp, mus musculus
gcttgttcaccatcaacaaagaaga

SEQ ID NO: 119527 - DNA, 25 bp, mus musculus
ttgttcaccatcaacaaagaagacc

SEQ ID NO: 119528 - DNA, 25 bp, mus musculus
ttcaccatcaacaaagaagaccaca

SEQ ID NO: 119529 - DNA, 25 bp, mus musculus
tcaccatcaacaaagaagaccacac

SEQ ID NO: 119530 - DNA, 25 bp, mus musculus
ccatcaacaaagaagaccacactct

SEQ ID NO: 119531 - DNA, 25 bp, mus musculus
aaatcgcagctgttgaaggacccgc

SEQ ID NO: 119532 - DNA, 25 bp, mus musculus
gacccgcaggtgctgtttgctggct

SEQ ID NO: 119533 - DNA, 25 bp, mus musculus
aggtgctgtttgctggctacaaagt

SEQ ID NO: 119534 - DNA, 25 bp, mus musculus
cagtgaaaagccacgtccaaactgt

SEQ ID NO: 119535 - DNA, 25 bp, mus musculus
aaagccacgtccaaactgtgctctg

SEQ ID NO: 119536 - DNA, 25 bp, mus musculus
agaagcctaggtgctctgcattccc

SEQ ID NO: 119537 - DNA, 25 bp, mus musculus
cattccctggggaactgcaggaaag

SEQ ID NO: 119538 - DNA, 25 bp, mus musculus
aaagccttacctgctgactgttgct

SEQ ID NO: 119539 - DNA, 25 bp, mus musculus
gccttacctgctgactgttgctctg

SEQ ID NO: 119540 - DNA, 25 bp, mus musculus
cctgctgactgttgctctggggaaa

SEQ ID NO: 119541 - DNA, 25 bp, mus musculus
gactgttgctctggggaaaagcctg

SEQ ID NO: 119542 - DNA, 25 bp, mus musculus
aagcctgagggtccagagcagctac

SEQ ID NO: 119543 - DNA, 25 bp, mus musculus
gagcagctacaagctacaggccata

SEQ ID NO: 119544 - DNA, 25 bp, mus musculus
cagctacaagctacaggccatacct

SEQ ID NO: 119545 - DNA, 25 bp, mus musculus
gctacaggccataccttacaacctg

SEQ ID NO: 119546 - DNA, 25 bp, mus musculus
acgtccaaactgtgctctgggctca

SEQ ID NO: 119547 - DNA, 25 bp, mus musculus
tccaaactgtgctctgggctcatca

SEQ ID NO: 119548 - DNA, 25 bp, mus musculus
atcccagtgggcacagagcggaatg

SEQ ID NO: 119549 - DNA, 25 bp, mus musculus
caatctggctgtccaacctagtttg

SEQ ID NO: 119550 - DNA, 25 bp, mus musculus
tacacaacaggggcagaaagccaag

SEQ ID NO: 119551 - DNA, 25 bp, mus musculus
tgttcaactttgtaacaagctgggt

SEQ ID NO: 119552 - DNA, 25 bp, mus musculus
ttacatgctccacgcagctagagaa

SEQ ID NO: 119553 - DNA, 25 bp, mus musculus
catgctccacgcagctagagaagcc

SEQ ID NO: 119554 - DNA, 25 bp, mus musculus
acaaggcctgtgggcgtctcatggt

SEQ ID NO: 119555 - DNA, 25 bp, mus musculus
gagagtcactacgcactcagggatg

SEQ ID NO: 119556 - DNA, 25 bp, mus musculus
actgcaccgtcacattgctggaggc

SEQ ID NO: 119557 - DNA, 25 bp, mus musculus
tgcaccgtcacattgctggaggcct

SEQ ID NO: 119558 - DNA, 25 bp, mus musculus
ccgtcacattgctggaggcctctgt

SEQ ID NO: 119559 - DNA, 25 bp, mus musculus
gtcacattgctggaggcctctgtag

SEQ ID NO: 119560 - DNA, 25 bp, mus musculus
cattgctggaggcctctgtagccgc

SEQ ID NO: 119561 - DNA, 25 bp, mus musculus
gaggcctctgtagccgctcttgtca

SEQ ID NO: 119562 - DNA, 25 bp, mus musculus
tctgtagccgctcttgtcatagatc

SEQ ID NO: 119563 - DNA, 25 bp, mus musculus
tgtagccgctcttgtcatagatcat

SEQ ID NO: 119564 - DNA, 25 bp, mus musculus
tagccgctcttgtcatagatcatat

SEQ ID NO: 119565 - DNA, 25 bp, mus musculus
gccgctcttgtcatagatcatatac

SEQ ID NO: 119566 - DNA, 25 bp, mus musculus
gagtcactacgcactcagggatgac

SEQ ID NO: 119567 - DNA, 25 bp, mus musculus
gtcactacgcactcagggatgacta

SEQ ID NO: 119568 - DNA, 25 bp, mus musculus
acgcactcagggatgactatgaggt

SEQ ID NO: 119569 - DNA, 25 bp, mus musculus
agctgccctgagctggatcaattgg

SEQ ID NO: 119570 - DNA, 25 bp, mus musculus
gccctgagctggatcaattggttga

SEQ ID NO: 119571 - DNA, 25 bp, mus musculus
attggttgaggccgcgctctctgtg

SEQ ID NO: 119572 - DNA, 25 bp, mus musculus
tatggcagtcgcatgacaggtggtg

SEQ ID NO: 119573 - DNA, 25 bp, mus musculus
atttggtgactgcaccgtcacattg

SEQ ID NO: 119574 - DNA, 25 bp, mus musculus
ggacctgcagctggagctgaactcg

SEQ ID NO: 119575 - DNA, 25 bp, mus musculus
gctgaactcggagtctgaagtcggg

SEQ ID NO: 119576 - DNA, 25 bp, mus musculus
ctccagcccttcaggaggcaagagg

SEQ ID NO: 119577 - DNA, 25 bp, mus musculus
gaaagacactaccgcagccaccgga

SEQ ID NO: 119578 - DNA, 25 bp, mus musculus
ccacctttcagcctccagagacttt

SEQ ID NO: 119579 - DNA, 25 bp, mus musculus
ttaaatggtcacatttcgtgcttct

SEQ ID NO: 119580 - DNA, 25 bp, mus musculus
aatggtcacatttcgtgcttctcgg

SEQ ID NO: 119581 - DNA, 25 bp, mus musculus
cacatttcgtgcttctcggatttct

SEQ ID NO: 119582 - DNA, 25 bp, mus musculus
atttcgtgcttctcggatttctgag

SEQ ID NO: 119583 - DNA, 25 bp, mus musculus
tcgtgcttctcggatttctgaggaa

SEQ ID NO: 119584 - DNA, 25 bp, mus musculus
ttctcggatttctgaggaaatattt

SEQ ID NO: 119585 - DNA, 25 bp, mus musculus
ttacaatgatcactggctgaaaata

SEQ ID NO: 119586 - DNA, 25 bp, mus musculus
cagcaccctgaacggcgagatcagt

SEQ ID NO: 119587 - DNA, 25 bp, mus musculus
ggcatgtgttccagccgacgatcgc

SEQ ID NO: 119588 - DNA, 25 bp, mus musculus
atgtgttccagccgacgatcgcatc

SEQ ID NO: 119589 - DNA, 25 bp, mus musculus
tgttccagccgacgatcgcatcttg

SEQ ID NO: 119590 - DNA, 25 bp, mus musculus
agccgacgatcgcatcttgtgtcgc

SEQ ID NO: 119591 - DNA, 25 bp, mus musculus
cgacgatcgcatcttgtgtcgctga

SEQ ID NO: 119592 - DNA, 25 bp, mus musculus
cggcgcactgagggaccagatggac

SEQ ID NO: 119593 - DNA, 25 bp, mus musculus
gatggactccagcccttcaggaggc

SEQ ID NO: 119594 - DNA, 25 bp, mus musculus
taattccaaccactggattaaatca

SEQ ID NO: 119595 - DNA, 25 bp, mus musculus
aatcctggcatagagcccatcacca

SEQ ID NO: 119596 - DNA, 25 bp, mus musculus
attttctgtggcattaattgcattc

SEQ ID NO: 119597 - DNA, 25 bp, mus musculus
aattgcattcataatgccattaagt

SEQ ID NO: 119598 - DNA, 25 bp, mus musculus
tgcattcataatgccattaagtatc

SEQ ID NO: 119599 - DNA, 25 bp, mus musculus
catcagtgtttctcaaacattttag

SEQ ID NO: 119600 - DNA, 25 bp, mus musculus
tgtttctcaaacattttagtcatcg

SEQ ID NO: 119601 - DNA, 25 bp, mus musculus
ttagtcatcgcaagcagacacttga

SEQ ID NO: 119602 - DNA, 25 bp, mus musculus
gtcatcgcaagcagacacttgatat

SEQ ID NO: 119603 - DNA, 25 bp, mus musculus
agcagacacttgatatctattaaat

SEQ ID NO: 119604 - DNA, 25 bp, mus musculus
ctcctcagtcctagctaatttcttc

SEQ ID NO: 119605 - DNA, 25 bp, mus musculus
ctcagtcctagctaatttcttcttt

SEQ ID NO: 119606 - DNA, 25 bp, mus musculus
cctggcatagagcccatcaccagca

SEQ ID NO: 119607 - DNA, 25 bp, mus musculus
gagcccatcaccagcacagtggggt

SEQ ID NO: 119608 - DNA, 25 bp, mus musculus
atttgtacatatttttccagaggat

SEQ ID NO: 119609 - DNA, 25 bp, mus musculus
tgtacatatttttccagaggatttt

SEQ ID NO: 119610 - DNA, 25 bp, mus musculus
gtgtcactcttggctatatagtgag

SEQ ID NO: 119611 - DNA, 25 bp, mus musculus
cctatctcaaattacatataagatt

SEQ ID NO: 119612 - DNA, 25 bp, mus musculus
atctcaaattacatataagattgtg

SEQ ID NO: 119613 - DNA, 25 bp, mus musculus
acattgcctacaattttctgtggca

SEQ ID NO: 119614 - DNA, 25 bp, mus musculus
tcgagctgtttcgcgacccacttcc

SEQ ID NO: 119615 - DNA, 25 bp, mus musculus
tgtttcgcgacccacttccaaagct

SEQ ID NO: 119616 - DNA, 25 bp, mus musculus
cctttcacagcactactgcaccatt

SEQ ID NO: 119617 - DNA, 25 bp, mus musculus
acagcactactgcaccattcacgtc

SEQ ID NO: 119618 - DNA, 25 bp, mus musculus
ctactgcaccattcacgtccgaggg

SEQ ID NO: 119619 - DNA, 25 bp, mus musculus
gcggcagctccatctaccgagacca

SEQ ID NO: 119620 - DNA, 25 bp, mus musculus
gctccatctaccgagaccaatttga

SEQ ID NO: 119621 - DNA, 25 bp, mus musculus
atgagaacttactctacagcataca

SEQ ID NO: 119622 - DNA, 25 bp, mus musculus
agaacttactctacagcatacacgt

SEQ ID NO: 119623 - DNA, 25 bp, mus musculus
tctacagcatacacgtctggcactc

SEQ ID NO: 119624 - DNA, 25 bp, mus musculus
caacaccggttccagtctttcactg

SEQ ID NO: 119625 - DNA, 25 bp, mus musculus
caccggttccagtctttcactgcac

SEQ ID NO: 119626 - DNA, 25 bp, mus musculus
ttcgcgacccacttccaaagctagc

SEQ ID NO: 119627 - DNA, 25 bp, mus musculus
ttccagtctttcactgcactgcacg

SEQ ID NO: 119628 - DNA, 25 bp, mus musculus
gcgacccacttccaaagctagcaga

SEQ ID NO: 119629 - DNA, 25 bp, mus musculus
acaactttcgagacctgacgcctgc

SEQ ID NO: 119630 - DNA, 25 bp, mus musculus
ttcgagacctgacgcctgcaccgac

SEQ ID NO: 119631 - DNA, 25 bp, mus musculus
gagacctgacgcctgcaccgacagg

SEQ ID NO: 119632 - DNA, 25 bp, mus musculus
cgcctgcaccgacaggattcggcta

SEQ ID NO: 119633 - DNA, 25 bp, mus musculus
ctgcaccgacaggattcggctataa

SEQ ID NO: 119634 - DNA, 25 bp, mus musculus
caccgacaggattcggctataaggc

SEQ ID NO: 119635 - DNA, 25 bp, mus musculus
agtgctctaggggtgcagaatattg

SEQ ID NO: 119636 - DNA, 25 bp, mus musculus
atcttcattgtcctggcagccggct

SEQ ID NO: 119637 - DNA, 25 bp, mus musculus
aagtgccagcgtcggctcaaacata

SEQ ID NO: 119638 - DNA, 25 bp, mus musculus
cggctcaaacataagccacaggccc

SEQ ID NO: 119639 - DNA, 25 bp, mus musculus
aagccacaggccccagttattgtga

SEQ ID NO: 119640 - DNA, 25 bp, mus musculus
caggccccagttattgtgaaaacag

SEQ ID NO: 119641 - DNA, 25 bp, mus musculus
gttatcaacatgcacacatttaacg

SEQ ID NO: 119642 - DNA, 25 bp, mus musculus
cacacatttaacgacagaaggttgc

SEQ ID NO: 119643 - DNA, 25 bp, mus musculus
accatggcatgaagctgggaggcca

SEQ ID NO: 119644 - DNA, 25 bp, mus musculus
aatcacccaagcacaaactgtcgtc

SEQ ID NO: 119645 - DNA, 25 bp, mus musculus
atgtttcctgtggaaatatgcaacc

SEQ ID NO: 119646 - DNA, 25 bp, mus musculus
gaaatatgcaacctgtgcaaaataa

SEQ ID NO: 119647 - DNA, 25 bp, mus musculus
attgtcctggcagccggcttggtgc

SEQ ID NO: 119648 - DNA, 25 bp, mus musculus
gaatcttctatttggttagtgccac

SEQ ID NO: 119649 - DNA, 25 bp, mus musculus
tggttagtgccaccataccatccag

SEQ ID NO: 119650 - DNA, 25 bp, mus musculus
ccataccatccagacactgtttagt

SEQ ID NO: 119651 - DNA, 25 bp, mus musculus
catccagacactgtttagtaaactt

SEQ ID NO: 119652 - DNA, 25 bp, mus musculus
atgaggtccttctgtagcgccatgg

SEQ ID NO: 119653 - DNA, 25 bp, mus musculus
tgtagcgccatggtggaagaactga

SEQ ID NO: 119654 - DNA, 25 bp, mus musculus
tctctgaagtgccagcgtcggctca

SEQ ID NO: 119655 - DNA, 25 bp, mus musculus
tcaatgtgaccatcgaggttagtgt

SEQ ID NO: 119656 - DNA, 25 bp, mus musculus
tgaccatcgaggttagtgtgaaaag

SEQ ID NO: 119657 - DNA, 25 bp, mus musculus
atgagcacatcacagccaacttcac

SEQ ID NO: 119658 - DNA, 25 bp, mus musculus
acatcacagccaacttcacccaata

SEQ ID NO: 119659 - DNA, 25 bp, mus musculus
tatcttctgtcccatgtgacaaaag

SEQ ID NO: 119660 - DNA, 25 bp, mus musculus
catatcatttcaaatctgtgccaag

SEQ ID NO: 119661 - DNA, 25 bp, mus musculus
atttcaaatctgtgccaagaaaagc

SEQ ID NO: 119662 - DNA, 25 bp, mus musculus
ttaacaatgctactctcttcctgag

SEQ ID NO: 119663 - DNA, 25 bp, mus musculus
ctctcttcctgagccactgtgtgaa

SEQ ID NO: 119664 - DNA, 25 bp, mus musculus
gatgcaggtgctcaccattgtgact

SEQ ID NO: 119665 - DNA, 25 bp, mus musculus
ggtgctcaccattgtgactcatgca

SEQ ID NO: 119666 - DNA, 25 bp, mus musculus
caccattgtgactcatgcaataaaa

SEQ ID NO: 119667 - DNA, 25 bp, mus musculus
ctgtgctacttgctgtcctggaaga

SEQ ID NO: 119668 - DNA, 25 bp, mus musculus
tcaaatttgaaaccaccatgacatc

SEQ ID NO: 119669 - DNA, 25 bp, mus musculus
ttgaaaccaccatgacatcctgggg

SEQ ID NO: 119670 - DNA, 25 bp, mus musculus
ccaccatgacatcctggggccttat

SEQ ID NO: 119671 - DNA, 25 bp, mus musculus
gccttattgtctcttctatcaacaa

SEQ ID NO: 119672 - DNA, 25 bp, mus musculus
ttgtctcttctatcaacaatatcgc

SEQ ID NO: 119673 - DNA, 25 bp, mus musculus
cttctatcaacaatatcgctgagaa

SEQ ID NO: 119674 - DNA, 25 bp, mus musculus
atcacaagacatactgggagtttct

SEQ ID NO: 119675 - DNA, 25 bp, mus musculus
agtttccaaatatcagagaagatag

SEQ ID NO: 119676 - DNA, 25 bp, mus musculus
gacacatacactacacagtatttag

SEQ ID NO: 119677 - DNA, 25 bp, mus musculus
gtatctgatttcccggatgtcatac

SEQ ID NO: 119678 - DNA, 25 bp, mus musculus
gatttcccggatgtcataccaatca

SEQ ID NO: 119679 - DNA, 25 bp, mus musculus
gtcataccaatcatccactcttatc

SEQ ID NO: 119680 - DNA, 25 bp, mus musculus
ccaatcatccactcttatcattaat

SEQ ID NO: 119681 - DNA, 25 bp, mus musculus
atccactcttatcattaatgagctt

SEQ ID NO: 119682 - DNA, 25 bp, mus musculus
tgagcttcattgttttgggttctaa

SEQ ID NO: 119683 - DNA, 25 bp, mus musculus
gagtagcctgccgatatagcagaga

SEQ ID NO: 119684 - DNA, 25 bp, mus musculus
ctcataatagcctcataagccagtc

SEQ ID NO: 119685 - DNA, 25 bp, mus musculus
atagcctcataagccagtcctggga

SEQ ID NO: 119686 - DNA, 25 bp, mus musculus
tcataagccagtcctgggaagaatt

SEQ ID NO: 119687 - DNA, 25 bp, mus musculus
tacactacacagtatttagacaatc

SEQ ID NO: 119688 - DNA, 25 bp, mus musculus
cataagccagtcctgggaagaattc

SEQ ID NO: 119689 - DNA, 25 bp, mus musculus
atgcagtattcttctggatgtatag

SEQ ID NO: 119690 - DNA, 25 bp, mus musculus
gacagcatgctgtgcagtagagaga

SEQ ID NO: 119691 - DNA, 25 bp, mus musculus
aatcttgctcctgtcttattcctta

SEQ ID NO: 119692 - DNA, 25 bp, mus musculus
gctcctgtcttattccttattccac

SEQ ID NO: 119693 - DNA, 25 bp, mus musculus
ctttgaccaaatattccctggatca

SEQ ID NO: 119694 - DNA, 25 bp, mus musculus
ccaaatattccctggatcaattcag

SEQ ID NO: 119695 - DNA, 25 bp, mus musculus
attccctggatcaattcagtatctg

SEQ ID NO: 119696 - DNA, 25 bp, mus musculus
ttaatgcctctccagcttctgcagt

SEQ ID NO: 119697 - DNA, 25 bp, mus musculus
atgcctctccagcttctgcagtgca

SEQ ID NO: 119698 - DNA, 25 bp, mus musculus
tttgtacatttcatcactcagtgca

SEQ ID NO: 119699 - DNA, 25 bp, mus musculus
gtacatttcatcactcagtgcatga

SEQ ID NO: 119700 - DNA, 25 bp, mus musculus
catttcatcactcagtgcatgagga

SEQ ID NO: 119701 - DNA, 25 bp, mus musculus
ttcatcactcagtgcatgaggaagc

SEQ ID NO: 119702 - DNA, 25 bp, mus musculus
atcactcagtgcatgaggaagcagc

SEQ ID NO: 119703 - DNA, 25 bp, mus musculus
aggaagcagcccaaggagagaccgg

SEQ ID NO: 119704 - DNA, 25 bp, mus musculus
cacccattcatcgtgcagttcaatg

SEQ ID NO: 119705 - DNA, 25 bp, mus musculus
ccattcatcgtgcagttcaatgatg

SEQ ID NO: 119706 - DNA, 25 bp, mus musculus
ttcatcgtgcagttcaatgatgggt

SEQ ID NO: 119707 - DNA, 25 bp, mus musculus
atcgtgcagttcaatgatgggtgac

SEQ ID NO: 119708 - DNA, 25 bp, mus musculus
cctctccagcttctgcagtgcattg

SEQ ID NO: 119709 - DNA, 25 bp, mus musculus
ctccagcttctgcagtgcattgttg

SEQ ID NO: 119710 - DNA, 25 bp, mus musculus
cttctgcagtgcattgttgatgagg

SEQ ID NO: 119711 - DNA, 25 bp, mus musculus
gattcgccggtccttccgcttggag

SEQ ID NO: 119712 - DNA, 25 bp, mus musculus
gtccttccgcttggagagttctcgg

SEQ ID NO: 119713 - DNA, 25 bp, mus musculus
cttccgcttggagagttctcggagc

SEQ ID NO: 119714 - DNA, 25 bp, mus musculus
gagttctcggagccgtttgtacatt

SEQ ID NO: 119715 - DNA, 25 bp, mus musculus
ttctcggagccgtttgtacatttca

SEQ ID NO: 119716 - DNA, 25 bp, mus musculus
tttttggcacacaataagcaaagta

SEQ ID NO: 119717 - DNA, 25 bp, mus musculus
gaccgttttggccaattgtatgttg

SEQ ID NO: 119718 - DNA, 25 bp, mus musculus
tgatctacccaatggccgagcaacg

SEQ ID NO: 119719 - DNA, 25 bp, mus musculus
tctacccaatggccgagcaacgtat

SEQ ID NO: 119720 - DNA, 25 bp, mus musculus
acccaatggccgagcaacgtatatt

SEQ ID NO: 119721 - DNA, 25 bp, mus musculus
tattgattacgtggctttcaataaa

SEQ ID NO: 119722 - DNA, 25 bp, mus musculus
tgaacaatacttaacatcgaaagga

SEQ ID NO: 119723 - DNA, 25 bp, mus musculus
attgcaattcgttatgcgaaactcg

SEQ ID NO: 119724 - DNA, 25 bp, mus musculus
attcgttatgcgaaactcgcaatat

SEQ ID NO: 119725 - DNA, 25 bp, mus musculus
ctcgcaatatgccgataatcaaact

SEQ ID NO: 119726 - DNA, 25 bp, mus musculus
ccaaaacatcattactcactttagg

SEQ ID NO: 119727 - DNA, 25 bp, mus musculus
tactcactttaggagttacagctca

SEQ ID NO: 119728 - DNA, 25 bp, mus musculus
tttggccaattgtatgttggcatca

SEQ ID NO: 119729 - DNA, 25 bp, mus musculus
accgttattgcgttgtatgatgcta

SEQ ID NO: 119730 - DNA, 25 bp, mus musculus
tatgatgctaacacaacaattcagg

SEQ ID NO: 119731 - DNA, 25 bp, mus musculus
gaatactgcgctgcattcgtgaaca

SEQ ID NO: 119732 - DNA, 25 bp, mus musculus
tactgcgctgcattcgtgaacatta

SEQ ID NO: 119733 - DNA, 25 bp, mus musculus
ttctatgcaaactaacacacatatt

SEQ ID NO: 119734 - DNA, 25 bp, mus musculus
tatgcaaactaacacacatattgga

SEQ ID NO: 119735 - DNA, 25 bp, mus musculus
cacacatattggacgactagtaaaa

SEQ ID NO: 119736 - DNA, 25 bp, mus musculus
gttctgcaaggattctgcgctggtc

SEQ ID NO: 119737 - DNA, 25 bp, mus musculus
tctgcaaggattctgcgctggtcgg

SEQ ID NO: 119738 - DNA, 25 bp, mus musculus
gctccaagccagacgacgatattct

SEQ ID NO: 119739 - DNA, 25 bp, mus musculus
tccaagccagacgacgatattcttg

SEQ ID NO: 119740 - DNA, 25 bp, mus musculus
caagccagacgacgatattcttgac

SEQ ID NO: 119741 - DNA, 25 bp, mus musculus
cgatattcttgacatcccgctggat

SEQ ID NO: 119742 - DNA, 25 bp, mus musculus
atattcttgacatcccgctggatga

SEQ ID NO: 119743 - DNA, 25 bp, mus musculus
attcttgacatcccgctggatgatc

SEQ ID NO: 119744 - DNA, 25 bp, mus musculus
tcttgacatcccgctggatgatccc

SEQ ID NO: 119745 - DNA, 25 bp, mus musculus
cgctgcagccaaaatccaggcgagt

SEQ ID NO: 119746 - DNA, 25 bp, mus musculus
ctgcagccaaaatccaggcgagttt

SEQ ID NO: 119747 - DNA, 25 bp, mus musculus
gcagccaaaatccaggcgagtttcc

SEQ ID NO: 119748 - DNA, 25 bp, mus musculus
gccaaggaccctcaacaccggcaat

SEQ ID NO: 119749 - DNA, 25 bp, mus musculus
caacaccggcaatggactgctgcac

SEQ ID NO: 119750 - DNA, 25 bp, mus musculus
acaccggcaatggactgctgcacgg

SEQ ID NO: 119751 - DNA, 25 bp, mus musculus
gcaatggactgctgcacggagagcg

SEQ ID NO: 119752 - DNA, 25 bp, mus musculus
aatggactgctgcacggagagcgcc

SEQ ID NO: 119753 - DNA, 25 bp, mus musculus
tggactgctgcacggagagcgcctg

SEQ ID NO: 119754 - DNA, 25 bp, mus musculus
gactgctgcacggagagcgcctgct

SEQ ID NO: 119755 - DNA, 25 bp, mus musculus
ctgctccaagccagacgacgatatt

SEQ ID NO: 119756 - DNA, 25 bp, mus musculus
agccagcagctccacgagagctagg

SEQ ID NO: 119757 - DNA, 25 bp, mus musculus
cagctccacgagagctaggcctagg

SEQ ID NO: 119758 - DNA, 25 bp, mus musculus
tcatgcccttgcctgagcctgagcc

SEQ ID NO: 119759 - DNA, 25 bp, mus musculus
tgctgcctccgctgagaattcctga

SEQ ID NO: 119760 - DNA, 25 bp, mus musculus
gctgcctccgctgagaattcctgag

SEQ ID NO: 119761 - DNA, 25 bp, mus musculus
tgcctccgctgagaattcctgagct

SEQ ID NO: 119762 - DNA, 25 bp, mus musculus
gcctccgctgagaattcctgagctc

SEQ ID NO: 119763 - DNA, 25 bp, mus musculus
tgagaattcctgagctcttgtctct

SEQ ID NO: 119764 - DNA, 25 bp, mus musculus
gagaattcctgagctcttgtctctc

SEQ ID NO: 119765 - DNA, 25 bp, mus musculus
aattcctgagctcttgtctctccgt

SEQ ID NO: 119766 - DNA, 25 bp, mus musculus
ttcctgagctcttgtctctccgtcc

SEQ ID NO: 119767 - DNA, 25 bp, mus musculus
tgagctcttgtctctccgtccacga

SEQ ID NO: 119768 - DNA, 25 bp, mus musculus
agctccacgagagctaggcctaggc

SEQ ID NO: 119769 - DNA, 25 bp, mus musculus
tttgggcctgaaggacaaggaagag

SEQ ID NO: 119770 - DNA, 25 bp, mus musculus
aggaagctagcgcacgagtggcagt

SEQ ID NO: 119771 - DNA, 25 bp, mus musculus
agccccagctgggcctgcagtcatt

SEQ ID NO: 119772 - DNA, 25 bp, mus musculus
ccccagctgggcctgcagtcattgg

SEQ ID NO: 119773 - DNA, 25 bp, mus musculus
cccagctgggcctgcagtcattggc

SEQ ID NO: 119774 - DNA, 25 bp, mus musculus
cagctgggcctgcagtcattggccc

SEQ ID NO: 119775 - DNA, 25 bp, mus musculus
tcgtcatgcccttgcctgagcctga

SEQ ID NO: 119776 - DNA, 25 bp, mus musculus
tcccctggactagaaactgcatctc

SEQ ID NO: 119777 - DNA, 25 bp, mus musculus
ctttaaaatctctcattaccttcag

SEQ ID NO: 119778 - DNA, 25 bp, mus musculus
tccatgcctgtatctgcacccattt

SEQ ID NO: 119779 - DNA, 25 bp, mus musculus
ccatgcctgtatctgcacccatttg

SEQ ID NO: 119780 - DNA, 25 bp, mus musculus
catgcctgtatctgcacccatttgt

SEQ ID NO: 119781 - DNA, 25 bp, mus musculus
cctgtatctgcacccatttgttctt

SEQ ID NO: 119782 - DNA, 25 bp, mus musculus
ctgtatctgcacccatttgttctta

SEQ ID NO: 119783 - DNA, 25 bp, mus musculus
tgtatctgcacccatttgttcttat

SEQ ID NO: 119784 - DNA, 25 bp, mus musculus
gtatctgcacccatttgttcttatt

SEQ ID NO: 119785 - DNA, 25 bp, mus musculus
atctgcacccatttgttcttattta

SEQ ID NO: 119786 - DNA, 25 bp, mus musculus
tttaaaatctctcattaccttcagt

SEQ ID NO: 119787 - DNA, 25 bp, mus musculus
ttaaaatctctcattaccttcagta

SEQ ID NO: 119788 - DNA, 25 bp, mus musculus
attttcagtatgtacatccatgcct

SEQ ID NO: 119789 - DNA, 25 bp, mus musculus
ttttcagtatgtacatccatgcctg

SEQ ID NO: 119790 - DNA, 25 bp, mus musculus
tttcagtatgtacatccatgcctgt

SEQ ID NO: 119791 - DNA, 25 bp, mus musculus
atgtacatccatgcctgtatctgca

SEQ ID NO: 119792 - DNA, 25 bp, mus musculus
tgtacatccatgcctgtatctgcac

SEQ ID NO: 119793 - DNA, 25 bp, mus musculus
gtacatccatgcctgtatctgcacc

SEQ ID NO: 119794 - DNA, 25 bp, mus musculus
agtgagtcctgaaccaaaatggaga

SEQ ID NO: 119795 - DNA, 25 bp, mus musculus
agaggactctcctggactaggacac

SEQ ID NO: 119796 - DNA, 25 bp, mus musculus
gcaaattctggcatctcaaaaatat

SEQ ID NO: 119797 - DNA, 25 bp, mus musculus
aaattctggcatctcaaaaatatca

SEQ ID NO: 119798 - DNA, 25 bp, mus musculus
attctggcatctcaaaaatatcagt

SEQ ID NO: 119799 - DNA, 25 bp, mus musculus
atctcaaaaatatcagtcatttttg

SEQ ID NO: 119800 - DNA, 25 bp, mus musculus
cagtaatgtgctttgctgtgtctat

SEQ ID NO: 119801 - DNA, 25 bp, mus musculus
ctttgctgtgtctatctgtaaagtc

SEQ ID NO: 119802 - DNA, 25 bp, mus musculus
tctatctgtaaagtcactgttatcc

SEQ ID NO: 119803 - DNA, 25 bp, mus musculus
taaagtcactgttatccttccattc

SEQ ID NO: 119804 - DNA, 25 bp, mus musculus
aagtcactgttatccttccattcca

SEQ ID NO: 119805 - DNA, 25 bp, mus musculus
cactgttatccttccattccatttg

SEQ ID NO: 119806 - DNA, 25 bp, mus musculus
ctaggacactgtacctcactgtgca

SEQ ID NO: 119807 - DNA, 25 bp, mus musculus
aggacactgtacctcactgtgcaaa

SEQ ID NO: 119808 - DNA, 25 bp, mus musculus
gacactgtacctcactgtgcaaatt

SEQ ID NO: 119809 - DNA, 25 bp, mus musculus
cactgtacctcactgtgcaaattct

SEQ ID NO: 119810 - DNA, 25 bp, mus musculus
gtacctcactgtgcaaattctggca

SEQ ID NO: 119811 - DNA, 25 bp, mus musculus
acctcactgtgcaaattctggcatc

SEQ ID NO: 119812 - DNA, 25 bp, mus musculus
ctcactgtgcaaattctggcatctc

SEQ ID NO: 119813 - DNA, 25 bp, mus musculus
gtgcaaattctggcatctcaaaaat

SEQ ID NO: 119814 - DNA, 25 bp, mus musculus
gcatgcagcactgctctggtaagca

SEQ ID NO: 119815 - DNA, 25 bp, mus musculus
atgcagcactgctctggtaagcaga

SEQ ID NO: 119816 - DNA, 25 bp, mus musculus
ctcatccgtgtggttcgcagaaagc

SEQ ID NO: 119817 - DNA, 25 bp, mus musculus
catccgtgtggttcgcagaaagcag

SEQ ID NO: 119818 - DNA, 25 bp, mus musculus
tgcgctgcgcacgtgtttggagcac

SEQ ID NO: 119819 - DNA, 25 bp, mus musculus
acgtgtttggagcactgcggatgac

SEQ ID NO: 119820 - DNA, 25 bp, mus musculus
gtttggagcactgcggatgacaagg

SEQ ID NO: 119821 - DNA, 25 bp, mus musculus
ttggagcactgcggatgacaaggag

SEQ ID NO: 119822 - DNA, 25 bp, mus musculus
tgaagaacacctgtgtcttgtagag

SEQ ID NO: 119823 - DNA, 25 bp, mus musculus
gtgtcttgtagaggcccagtgctca

SEQ ID NO: 119824 - DNA, 25 bp, mus musculus
tgtagaggcccagtgctcagaaccg

SEQ ID NO: 119825 - DNA, 25 bp, mus musculus
tagaggcccagtgctcagaaccggg

SEQ ID NO: 119826 - DNA, 25 bp, mus musculus
gcagcactgctctggtaagcagatg

SEQ ID NO: 119827 - DNA, 25 bp, mus musculus
cactgctctggtaagcagatgcatc

SEQ ID NO: 119828 - DNA, 25 bp, mus musculus
aagcagatgcatcctttcctgaccc

SEQ ID NO: 119829 - DNA, 25 bp, mus musculus
agatgcatcctttcctgaccccggg

SEQ ID NO: 119830 - DNA, 25 bp, mus musculus
ctcctgggaacctctatggtctgcc

SEQ ID NO: 119831 - DNA, 25 bp, mus musculus
cctgggaacctctatggtctgcctc

SEQ ID NO: 119832 - DNA, 25 bp, mus musculus
ggaacctctatggtctgcctcatcc

SEQ ID NO: 119833 - DNA, 25 bp, mus musculus
gcctcatccgtgtggttcgcagaaa

SEQ ID NO: 119834 - DNA, 25 bp, mus musculus
aggatcaggaccaaacagcccagaa

SEQ ID NO: 119835 - DNA, 25 bp, mus musculus
gatcaggaccaaacagcccagaaga

SEQ ID NO: 119836 - DNA, 25 bp, mus musculus
gaagaccagcagcattggcaacatt

SEQ ID NO: 119837 - DNA, 25 bp, mus musculus
agaccagcagcattggcaacattca

SEQ ID NO: 119838 - DNA, 25 bp, mus musculus
accagcagcattggcaacattcacc

SEQ ID NO: 119839 - DNA, 25 bp, mus musculus
cagcagcattggcaacattcaccat

SEQ ID NO: 119840 - DNA, 25 bp, mus musculus
gcagcattggcaacattcaccatgg

SEQ ID NO: 119841 - DNA, 25 bp, mus musculus
cattggcaacattcaccatggctag

SEQ ID NO: 119842 - DNA, 25 bp, mus musculus
ttggcaacattcaccatggctaggc

SEQ ID NO: 119843 - DNA, 25 bp, mus musculus
caacattcaccatggctaggctctg

SEQ ID NO: 119844 - DNA, 25 bp, mus musculus
acattcaccatggctaggctctgtg

SEQ ID NO: 119845 - DNA, 25 bp, mus musculus
attcaccatggctaggctctgtgct

SEQ ID NO: 119846 - DNA, 25 bp, mus musculus
tcaggaccaaacagcccagaagacc

SEQ ID NO: 119847 - DNA, 25 bp, mus musculus
aggaccaaacagcccagaagaccag

SEQ ID NO: 119848 - DNA, 25 bp, mus musculus
gaccaaacagcccagaagaccagca

SEQ ID NO: 119849 - DNA, 25 bp, mus musculus
ccaaacagcccagaagaccagcagc

SEQ ID NO: 119850 - DNA, 25 bp, mus musculus
acagcccagaagaccagcagcattg

SEQ ID NO: 119851 - DNA, 25 bp, mus musculus
agcccagaagaccagcagcattggc

SEQ ID NO: 119852 - DNA, 25 bp, mus musculus
cccagaagaccagcagcattggcaa

SEQ ID NO: 119853 - DNA, 25 bp, mus musculus
cagaagaccagcagcattggcaaca

SEQ ID NO: 119854 - DNA, 25 bp, mus musculus
agagctttctgtcactagtgtcaga

SEQ ID NO: 119855 - DNA, 25 bp, mus musculus
agctttctgtcactagtgtcagagc

SEQ ID NO: 119856 - DNA, 25 bp, mus musculus
cacttgaggaactgcccactgcttc

SEQ ID NO: 119857 - DNA, 25 bp, mus musculus
ttgaggaactgcccactgcttcttg

SEQ ID NO: 119858 - DNA, 25 bp, mus musculus
gaggaactgcccactgcttcttgtg

SEQ ID NO: 119859 - DNA, 25 bp, mus musculus
aggaactgcccactgcttcttgtga

SEQ ID NO: 119860 - DNA, 25 bp, mus musculus
gaactgcccactgcttcttgtgaca

SEQ ID NO: 119861 - DNA, 25 bp, mus musculus
aactgcccactgcttcttgtgacag

SEQ ID NO: 119862 - DNA, 25 bp, mus musculus
tgcccactgcttcttgtgacagata

SEQ ID NO: 119863 - DNA, 25 bp, mus musculus
cccactgcttcttgtgacagatagg

SEQ ID NO: 119864 - DNA, 25 bp, mus musculus
ccactgcttcttgtgacagatagga

SEQ ID NO: 119865 - DNA, 25 bp, mus musculus
actgcttcttgtgacagataggacc

SEQ ID NO: 119866 - DNA, 25 bp, mus musculus
gctttctgtcactagtgtcagagct

SEQ ID NO: 119867 - DNA, 25 bp, mus musculus
tttctgtcactagtgtcagagctct

SEQ ID NO: 119868 - DNA, 25 bp, mus musculus
ttctgtcactagtgtcagagctcta

SEQ ID NO: 119869 - DNA, 25 bp, mus musculus
ctgtcactagtgtcagagctctaca

SEQ ID NO: 119870 - DNA, 25 bp, mus musculus
ctctacagtgcgtgaaatgactatc

SEQ ID NO: 119871 - DNA, 25 bp, mus musculus
gtgttcaccacgggtcacttgagga

SEQ ID NO: 119872 - DNA, 25 bp, mus musculus
ttcaccacgggtcacttgaggaact

SEQ ID NO: 119873 - DNA, 25 bp, mus musculus
caccacgggtcacttgaggaactgc

SEQ ID NO: 119874 - DNA, 25 bp, mus musculus
ccctgtcctacaagagctgacccag

SEQ ID NO: 119875 - DNA, 25 bp, mus musculus
ctgtcctacaagagctgacccagca

SEQ ID NO: 119876 - DNA, 25 bp, mus musculus
gactctatctctcttcttaagctct

SEQ ID NO: 119877 - DNA, 25 bp, mus musculus
ctctatctctcttcttaagctctcc

SEQ ID NO: 119878 - DNA, 25 bp, mus musculus
gaatacaatcaaccagcctagatgt

SEQ ID NO: 119879 - DNA, 25 bp, mus musculus
atacaatcaaccagcctagatgttc

SEQ ID NO: 119880 - DNA, 25 bp, mus musculus
aatcaaccagcctagatgttccagc

SEQ ID NO: 119881 - DNA, 25 bp, mus musculus
aaccagcctagatgttccagcaaaa

SEQ ID NO: 119882 - DNA, 25 bp, mus musculus
ccagcctagatgttccagcaaaact

SEQ ID NO: 119883 - DNA, 25 bp, mus musculus
tagatgttccagcaaaactgagcaa

SEQ ID NO: 119884 - DNA, 25 bp, mus musculus
gatgttccagcaaaactgagcaaag

SEQ ID NO: 119885 - DNA, 25 bp, mus musculus
aagattttctgcgtgtaaaaacatg

SEQ ID NO: 119886 - DNA, 25 bp, mus musculus
gtcctacaagagctgacccagcagg

SEQ ID NO: 119887 - DNA, 25 bp, mus musculus
cctacaagagctgacccagcaggtc

SEQ ID NO: 119888 - DNA, 25 bp, mus musculus
caagagctgacccagcaggtcctga

SEQ ID NO: 119889 - DNA, 25 bp, mus musculus
caaagcctgtgtgatgcaggaggtg

SEQ ID NO: 119890 - DNA, 25 bp, mus musculus
aggactctcctgaatgaggactcta

SEQ ID NO: 119891 - DNA, 25 bp, mus musculus
gactctcctgaatgaggactctatc

SEQ ID NO: 119892 - DNA, 25 bp, mus musculus
ctctcctgaatgaggactctatctc

SEQ ID NO: 119893 - DNA, 25 bp, mus musculus
aatgaggactctatctctcttctta

SEQ ID NO: 119894 - DNA, 25 bp, mus musculus
gaaggagcccagatcaacaggcagg

SEQ ID NO: 119895 - DNA, 25 bp, mus musculus
aaggagcccagatcaacaggcaggt

SEQ ID NO: 119896 - DNA, 25 bp, mus musculus
ggccgcgcactccaagtccacagag

SEQ ID NO: 119897 - DNA, 25 bp, mus musculus
gccgcgcactccaagtccacagagg

SEQ ID NO: 119898 - DNA, 25 bp, mus musculus
gcgcactccaagtccacagaggaat

SEQ ID NO: 119899 - DNA, 25 bp, mus musculus
gcactccaagtccacagaggaatgt

SEQ ID NO: 119900 - DNA, 25 bp, mus musculus
cactccaagtccacagaggaatgtt

SEQ ID NO: 119901 - DNA, 25 bp, mus musculus
ctccaagtccacagaggaatgtttg

SEQ ID NO: 119902 - DNA, 25 bp, mus musculus
tccaagtccacagaggaatgtttgt

SEQ ID NO: 119903 - DNA, 25 bp, mus musculus
gagcgagaccacaggccttacccca

SEQ ID NO: 119904 - DNA, 25 bp, mus musculus
taccccagaccaagttaagcgacat

SEQ ID NO: 119905 - DNA, 25 bp, mus musculus
cccagaccaagttaagcgacatctg

SEQ ID NO: 119906 - DNA, 25 bp, mus musculus
ggagcccagatcaacaggcaggtgg

SEQ ID NO: 119907 - DNA, 25 bp, mus musculus
gagcccagatcaacaggcaggtgga

SEQ ID NO: 119908 - DNA, 25 bp, mus musculus
gcccagatcaacaggcaggtggata

SEQ ID NO: 119909 - DNA, 25 bp, mus musculus
cccagatcaacaggcaggtggataa

SEQ ID NO: 119910 - DNA, 25 bp, mus musculus
cagatcaacaggcaggtggataagc

SEQ ID NO: 119911 - DNA, 25 bp, mus musculus
agatcaacaggcaggtggataagct

SEQ ID NO: 119912 - DNA, 25 bp, mus musculus
tggcccccaggaagggagcacaatg

SEQ ID NO: 119913 - DNA, 25 bp, mus musculus
cacaatggaggccgcgcactccaag

SEQ ID NO: 119914 - DNA, 25 bp, mus musculus
cccacctgtcctggggcttgcaacg

SEQ ID NO: 119915 - DNA, 25 bp, mus musculus
tgtcctggggcttgcaacggccacg

SEQ ID NO: 119916 - DNA, 25 bp, mus musculus
gactgcagcgagcacgctgtcctgg

SEQ ID NO: 119917 - DNA, 25 bp, mus musculus
cacgctgtcctggcgactgtagtgg

SEQ ID NO: 119918 - DNA, 25 bp, mus musculus
gctgtcctggcgactgtagtggcaa

SEQ ID NO: 119919 - DNA, 25 bp, mus musculus
gtcctggcgactgtagtggcaatgg

SEQ ID NO: 119920 - DNA, 25 bp, mus musculus
tctgtgacactggcgagtgttactg

SEQ ID NO: 119921 - DNA, 25 bp, mus musculus
tgacactggcgagtgttactgtgag

SEQ ID NO: 119922 - DNA, 25 bp, mus musculus
gacactggcgagtgttactgtgaga

SEQ ID NO: 119923 - DNA, 25 bp, mus musculus
acactggcgagtgttactgtgagat

SEQ ID NO: 119924 - DNA, 25 bp, mus musculus
cactggcgagtgttactgtgagatg

SEQ ID NO: 119925 - DNA, 25 bp, mus musculus
tactggccccgactgttcccaggtg

SEQ ID NO: 119926 - DNA, 25 bp, mus musculus
gcctgtccccaggactgcagtgggc

SEQ ID NO: 119927 - DNA, 25 bp, mus musculus
ccccaggactgcagtgggcatggcg

SEQ ID NO: 119928 - DNA, 25 bp, mus musculus
tgcgtgcagggtgtctgccagtgcc

SEQ ID NO: 119929 - DNA, 25 bp, mus musculus
tgccacgaggacttcacagcagagg

SEQ ID NO: 119930 - DNA, 25 bp, mus musculus
cacgaggacttcacagcagaggact

SEQ ID NO: 119931 - DNA, 25 bp, mus musculus
gaggacttcacagcagaggactgca

SEQ ID NO: 119932 - DNA, 25 bp, mus musculus
gacttcacagcagaggactgcagcg

SEQ ID NO: 119933 - DNA, 25 bp, mus musculus
ttcacagcagaggactgcagcgagc

SEQ ID NO: 119934 - DNA, 25 bp, mus musculus
gcacgtcatgagcaccaggttatgc

SEQ ID NO: 119935 - DNA, 25 bp, mus musculus
acgtcatgagcaccaggttatgcta

SEQ ID NO: 119936 - DNA, 25 bp, mus musculus
acgttagaactcaggcaggaagagg

SEQ ID NO: 119937 - DNA, 25 bp, mus musculus
ttagaactcaggcaggaagaggaac

SEQ ID NO: 119938 - DNA, 25 bp, mus musculus
gaaatgatgcgccgacagcaggaag

SEQ ID NO: 119939 - DNA, 25 bp, mus musculus
aaatgatgcgccgacagcaggaagg

SEQ ID NO: 119940 - DNA, 25 bp, mus musculus
aatgatgcgccgacagcaggaagga

SEQ ID NO: 119941 - DNA, 25 bp, mus musculus
tgatgcgccgacagcaggaaggatt

SEQ ID NO: 119942 - DNA, 25 bp, mus musculus
gaaccttccctgatgcgagagaaca

SEQ ID NO: 119943 - DNA, 25 bp, mus musculus
accttccctgatgcgagagaacaag

SEQ ID NO: 119944 - DNA, 25 bp, mus musculus
ccttccctgatgcgagagaacaaga

SEQ ID NO: 119945 - DNA, 25 bp, mus musculus
cttccctgatgcgagagaacaagag

SEQ ID NO: 119946 - DNA, 25 bp, mus musculus
cgtcatgagcaccaggttatgctaa

SEQ ID NO: 119947 - DNA, 25 bp, mus musculus
catgagcaccaggttatgctaatga

SEQ ID NO: 119948 - DNA, 25 bp, mus musculus
atgagcaccaggttatgctaatgag

SEQ ID NO: 119949 - DNA, 25 bp, mus musculus
tgagcaccaggttatgctaatgagg

SEQ ID NO: 119950 - DNA, 25 bp, mus musculus
agcaccaggttatgctaatgaggca

SEQ ID NO: 119951 - DNA, 25 bp, mus musculus
gaaacacgttagaactcaggcagga

SEQ ID NO: 119952 - DNA, 25 bp, mus musculus
acacgttagaactcaggcaggaaga

SEQ ID NO: 119953 - DNA, 25 bp, mus musculus
cacgttagaactcaggcaggaagag

SEQ ID NO: 119954 - DNA, 25 bp, mus musculus
agcccaaagcagctatcggttgcag

SEQ ID NO: 119955 - DNA, 25 bp, mus musculus
aagcagctatcggttgcagcagcgg

SEQ ID NO: 119956 - DNA, 25 bp, mus musculus
ttcctgtgcaggcacatgttcttaa

SEQ ID NO: 119957 - DNA, 25 bp, mus musculus
tgcaggcacatgttcttaaggaatg

SEQ ID NO: 119958 - DNA, 25 bp, mus musculus
aggaatgccatgcacacaggcctga

SEQ ID NO: 119959 - DNA, 25 bp, mus musculus
cacacaggcctgaagagctggctca

SEQ ID NO: 119960 - DNA, 25 bp, mus musculus
tagagcacaggttgctcttgtctgg

SEQ ID NO: 119961 - DNA, 25 bp, mus musculus
tgctcttgtctgggatctgagctct

SEQ ID NO: 119962 - DNA, 25 bp, mus musculus
cagcacccacagagtgcttctggtt

SEQ ID NO: 119963 - DNA, 25 bp, mus musculus
tgcctcagactccaggggtgcacaa

SEQ ID NO: 119964 - DNA, 25 bp, mus musculus
agactccaggggtgcacaaggccat

SEQ ID NO: 119965 - DNA, 25 bp, mus musculus
tgcacaaggccatgtaagcaaagac

SEQ ID NO: 119966 - DNA, 25 bp, mus musculus
gcttcacctgagcctggccttctgg

SEQ ID NO: 119967 - DNA, 25 bp, mus musculus
cctgagcctggccttctgggcgagc

SEQ ID NO: 119968 - DNA, 25 bp, mus musculus
cttctgggcgagcagttctacctgc

SEQ ID NO: 119969 - DNA, 25 bp, mus musculus
cagttctacctgcacacttcaagac

SEQ ID NO: 119970 - DNA, 25 bp, mus musculus
tacctgcacacttcaagacagcctc

SEQ ID NO: 119971 - DNA, 25 bp, mus musculus
cacacttcaagacagcctccatgac

SEQ ID NO: 119972 - DNA, 25 bp, mus musculus
tcacggcacaccgcctgcttttggt

SEQ ID NO: 119973 - DNA, 25 bp, mus musculus
cacaccgcctgcttttggtgtgacc

SEQ ID NO: 119974 - DNA, 25 bp, mus musculus
tggaccaactaagcctaccagctca

SEQ ID NO: 119975 - DNA, 25 bp, mus musculus
gctcaccctacacagatttcgatgg

SEQ ID NO: 119976 - DNA, 25 bp, mus musculus
atccactgattgacaagatggtggt

SEQ ID NO: 119977 - DNA, 25 bp, mus musculus
acaatatacacatatagatggagag

SEQ ID NO: 119978 - DNA, 25 bp, mus musculus
tggagagaacaccacctttaacaat

SEQ ID NO: 119979 - DNA, 25 bp, mus musculus
gagaacaccacctttaacaatactg

SEQ ID NO: 119980 - DNA, 25 bp, mus musculus
ggtttttactcaatatcacagcaga

SEQ ID NO: 119981 - DNA, 25 bp, mus musculus
tttttactcaatatcacagcagata

SEQ ID NO: 119982 - DNA, 25 bp, mus musculus
tttactcaatatcacagcagatata

SEQ ID NO: 119983 - DNA, 25 bp, mus musculus
ctcaatatcacagcagatatacaca

SEQ ID NO: 119984 - DNA, 25 bp, mus musculus
caatatcacagcagatatacacaca

SEQ ID NO: 119985 - DNA, 25 bp, mus musculus
atatcacagcagatatacacacatg

SEQ ID NO: 119986 - DNA, 25 bp, mus musculus
accctacacagatttcgatggtgct

SEQ ID NO: 119987 - DNA, 25 bp, mus musculus
agatatacacacatgcgcatgcgag

SEQ ID NO: 119988 - DNA, 25 bp, mus musculus
cctacacagatttcgatggtgctaa

SEQ ID NO: 119989 - DNA, 25 bp, mus musculus
tcggaaccctctttgtcccacagcg

SEQ ID NO: 119990 - DNA, 25 bp, mus musculus
ggaaccctctttgtcccacagcgca

SEQ ID NO: 119991 - DNA, 25 bp, mus musculus
gtcccacagcgcaaactggaagtct

SEQ ID NO: 119992 - DNA, 25 bp, mus musculus
cccacagcgcaaactggaagtctca

SEQ ID NO: 119993 - DNA, 25 bp, mus musculus
ggatatccactgattgacaagatgg

SEQ ID NO: 119994 - DNA, 25 bp, mus musculus
atatccactgattgacaagatggtg

SEQ ID NO: 119995 - DNA, 25 bp, mus musculus
atccctatggagatgacggagaaga

SEQ ID NO: 119996 - DNA, 25 bp, mus musculus
aagagttacactgcctttgccatcc

SEQ ID NO: 119997 - DNA, 25 bp, mus musculus
tcaactgctctccacttgaagagct

SEQ ID NO: 119998 - DNA, 25 bp, mus musculus
aagtacaacagctacgcctggatgg

SEQ ID NO: 119999 - DNA, 25 bp, mus musculus
ttcaggaactttctcatcattcgaa

SEQ ID NO: 120000 - DNA, 25 bp, mus musculus
aactttctcatcattcgaagactta

SEQ ID NO: 120001 - DNA, 25 bp, mus musculus
ctcatcattcgaagacttaccagaa

SEQ ID NO: 120002 - DNA, 25 bp, mus musculus
tgaagacctgtcagttgatgcctca

SEQ ID NO: 120003 - DNA, 25 bp, mus musculus
aggcaacctttaagcatcagaggcg

SEQ ID NO: 120004 - DNA, 25 bp, mus musculus
cctttaagcatcagaggcggactct

SEQ ID NO: 120005 - DNA, 25 bp, mus musculus
agcatcagaggcggactctgggact

SEQ ID NO: 120006 - DNA, 25 bp, mus musculus
tgaatctactgcatttgaaaggtca

SEQ ID NO: 120007 - DNA, 25 bp, mus musculus
tacactgcctttgccatccaagaga

SEQ ID NO: 120008 - DNA, 25 bp, mus musculus
gcctttgccatccaagagatgctcc

SEQ ID NO: 120009 - DNA, 25 bp, mus musculus
cagaatgtctttcttgtcttcagaa

SEQ ID NO: 120010 - DNA, 25 bp, mus musculus
gtctttcttgtcttcagaaacaatt

SEQ ID NO: 120011 - DNA, 25 bp, mus musculus
ttcagaaacaatttctccagcactg

SEQ ID NO: 120012 - DNA, 25 bp, mus musculus
actattgttgtacgtctcctggatg

SEQ ID NO: 120013 - DNA, 25 bp, mus musculus
cgtctcctggatgaactccaccagc

SEQ ID NO: 120014 - DNA, 25 bp, mus musculus
atgtcctcaactgctctccacttga

SEQ ID NO: 120015 - DNA, 25 bp, mus musculus
aaggaagacgccttctacagctggg

SEQ ID NO: 120016 - DNA, 25 bp, mus musculus
aggaagacgccttctacagctggga

SEQ ID NO: 120017 - DNA, 25 bp, mus musculus
acttggagccatggacacgtggatg

SEQ ID NO: 120018 - DNA, 25 bp, mus musculus
cttggagccatggacacgtggatgg

SEQ ID NO: 120019 - DNA, 25 bp, mus musculus
gagccatggacacgtggatggccca

SEQ ID NO: 120020 - DNA, 25 bp, mus musculus
agccatggacacgtggatggcccag

SEQ ID NO: 120021 - DNA, 25 bp, mus musculus
gccatggacacgtggatggcccagc

SEQ ID NO: 120022 - DNA, 25 bp, mus musculus
ccatggacacgtggatggcccagcc

SEQ ID NO: 120023 - DNA, 25 bp, mus musculus
tggacacgtggatggcccagccagc

SEQ ID NO: 120024 - DNA, 25 bp, mus musculus
agccagccagccgcctggactgcag

SEQ ID NO: 120025 - DNA, 25 bp, mus musculus
gccagccagccgcctggactgcagg

SEQ ID NO: 120026 - DNA, 25 bp, mus musculus
ccagccagccgcctggactgcaggg

SEQ ID NO: 120027 - DNA, 25 bp, mus musculus
ggaagacgccttctacagctgggag

SEQ ID NO: 120028 - DNA, 25 bp, mus musculus
gaagacgccttctacagctgggaga

SEQ ID NO: 120029 - DNA, 25 bp, mus musculus
aagacgccttctacagctgggagag

SEQ ID NO: 120030 - DNA, 25 bp, mus musculus
gagtctgatcacaactgatggctgg

SEQ ID NO: 120031 - DNA, 25 bp, mus musculus
agtctgatcacaactgatggctggt

SEQ ID NO: 120032 - DNA, 25 bp, mus musculus
gtctgatcacaactgatggctggtg

SEQ ID NO: 120033 - DNA, 25 bp, mus musculus
ctgatcacaactgatggctggtggg

SEQ ID NO: 120034 - DNA, 25 bp, mus musculus
gacttggagccatggacacgtggat

SEQ ID NO: 120035 - DNA, 25 bp, mus musculus
gttggaccccctgtgatgcttgatg

SEQ ID NO: 120036 - DNA, 25 bp, mus musculus
ccccctgtgatgcttgatgctgcaa

SEQ ID NO: 120037 - DNA, 25 bp, mus musculus
actctgcagctttcaaagctcgaac

SEQ ID NO: 120038 - DNA, 25 bp, mus musculus
tctgcagctttcaaagctcgaacaa

SEQ ID NO: 120039 - DNA, 25 bp, mus musculus
tgcagctttcaaagctcgaacaaaa

SEQ ID NO: 120040 - DNA, 25 bp, mus musculus
cagctttcaaagctcgaacaaaagc

SEQ ID NO: 120041 - DNA, 25 bp, mus musculus
tttcaaagctcgaacaaaagctcga

SEQ ID NO: 120042 - DNA, 25 bp, mus musculus
aaagctcgaacaaaagctcgaagca

SEQ ID NO: 120043 - DNA, 25 bp, mus musculus
agctcgaacaaaagctcgaagcaaa

SEQ ID NO: 120044 - DNA, 25 bp, mus musculus
aaagctcgaagcaaatgccgagata

SEQ ID NO: 120045 - DNA, 25 bp, mus musculus
tttgctacttctaatgtatataagc

SEQ ID NO: 120046 - DNA, 25 bp, mus musculus
tgctacttctaatgtatataagctt

SEQ ID NO: 120047 - DNA, 25 bp, mus musculus
ccctgtgatgcttgatgctgcaaca

SEQ ID NO: 120048 - DNA, 25 bp, mus musculus
tgcttgatgctgcaacacttaaaac

SEQ ID NO: 120049 - DNA, 25 bp, mus musculus
cttgatgctgcaacacttaaaacca

SEQ ID NO: 120050 - DNA, 25 bp, mus musculus
tgatgctgcaacacttaaaaccatg

SEQ ID NO: 120051 - DNA, 25 bp, mus musculus
atgctgcaacacttaaaaccatgaa

SEQ ID NO: 120052 - DNA, 25 bp, mus musculus
tgcaacacttaaaaccatgaagatt

SEQ ID NO: 120053 - DNA, 25 bp, mus musculus
tatataactctgcagctttcaaagc

SEQ ID NO: 120054 - DNA, 25 bp, mus musculus
tataactctgcagctttcaaagctc

SEQ ID NO: 120055 - DNA, 25 bp, mus musculus
ccgtcaccttaagtgccacaaccag

SEQ ID NO: 120056 - DNA, 25 bp, mus musculus
tcaccttaagtgccacaaccaggta

SEQ ID NO: 120057 - DNA, 25 bp, mus musculus
cttcacccagcggtgttccttggag

SEQ ID NO: 120058 - DNA, 25 bp, mus musculus
gaagatccacggggtacagcagcag

SEQ ID NO: 120059 - DNA, 25 bp, mus musculus
gatccacggggtacagcagcagtat

SEQ ID NO: 120060 - DNA, 25 bp, mus musculus
acagcagcagtatgcctacaagcag

SEQ ID NO: 120061 - DNA, 25 bp, mus musculus
gtatgcctacaagcagcgtcgcgac

SEQ ID NO: 120062 - DNA, 25 bp, mus musculus
tgcctacaagcagcgtcgcgacaaa

SEQ ID NO: 120063 - DNA, 25 bp, mus musculus
ctacaagcagcgtcgcgacaaactc

SEQ ID NO: 120064 - DNA, 25 bp, mus musculus
gcagcgtcgcgacaaactctacgtg

SEQ ID NO: 120065 - DNA, 25 bp, mus musculus
gcgtcgcgacaaactctacgtgtgt

SEQ ID NO: 120066 - DNA, 25 bp, mus musculus
tcgcgacaaactctacgtgtgtgag

SEQ ID NO: 120067 - DNA, 25 bp, mus musculus
gtgccacaaccaggtaaagaggcac

SEQ ID NO: 120068 - DNA, 25 bp, mus musculus
gaggcacctgtgcaccttctgcggc

SEQ ID NO: 120069 - DNA, 25 bp, mus musculus
cctgtgcaccttctgcggcaagggc

SEQ ID NO: 120070 - DNA, 25 bp, mus musculus
gtgcaccttctgcggcaagggcttc

SEQ ID NO: 120071 - DNA, 25 bp, mus musculus
caccttctgcggcaagggcttcaat

SEQ ID NO: 120072 - DNA, 25 bp, mus musculus
caatgacaccttcgacctgaagagg

SEQ ID NO: 120073 - DNA, 25 bp, mus musculus
cttcgacctgaagaggcacgtacgc

SEQ ID NO: 120074 - DNA, 25 bp, mus musculus
taacaaggccttcacccagcggtgt

SEQ ID NO: 120075 - DNA, 25 bp, mus musculus
gcccatctgcctgccgaacaatggg

SEQ ID NO: 120076 - DNA, 25 bp, mus musculus
ctgcctgccgaacaatgggctcgct

SEQ ID NO: 120077 - DNA, 25 bp, mus musculus
caccaacaactatggcatctacacc

SEQ ID NO: 120078 - DNA, 25 bp, mus musculus
caactatggcatctacaccaaagtg

SEQ ID NO: 120079 - DNA, 25 bp, mus musculus
tggcatctacaccaaagtgggaagc

SEQ ID NO: 120080 - DNA, 25 bp, mus musculus
ctacctcaaatggattcacagttac

SEQ ID NO: 120081 - DNA, 25 bp, mus musculus
gattcacagttacattggggaaaag

SEQ ID NO: 120082 - DNA, 25 bp, mus musculus
ctcccttaagagccagaagctatag

SEQ ID NO: 120083 - DNA, 25 bp, mus musculus
gctcacctctggaccctagaagtca

SEQ ID NO: 120084 - DNA, 25 bp, mus musculus
ctctggaccctagaagtcactcttg

SEQ ID NO: 120085 - DNA, 25 bp, mus musculus
gaagtcactcttggagtaaggctgg

SEQ ID NO: 120086 - DNA, 25 bp, mus musculus
actcttggagtaaggctgggctagt

SEQ ID NO: 120087 - DNA, 25 bp, mus musculus
tcagcaggagctcactcaggctggc

SEQ ID NO: 120088 - DNA, 25 bp, mus musculus
cactcaggctggccaggagacagtg

SEQ ID NO: 120089 - DNA, 25 bp, mus musculus
catccctttggttgctcgaaatgag

SEQ ID NO: 120090 - DNA, 25 bp, mus musculus
tgctcgaaatgagtgcgtggaggtc

SEQ ID NO: 120091 - DNA, 25 bp, mus musculus
catgctgtgtgcaggcatcattggg

SEQ ID NO: 120092 - DNA, 25 bp, mus musculus
gaacacgagagacgcctgtgatggt

SEQ ID NO: 120093 - DNA, 25 bp, mus musculus
gagagacgcctgtgatggtgacagt

SEQ ID NO: 120094 - DNA, 25 bp, mus musculus
tgggcacaccaacaactatggcatc

SEQ ID NO: 120095 - DNA, 25 bp, mus musculus
gctatgccttgtttcagataccaca

SEQ ID NO: 120096 - DNA, 25 bp, mus musculus
ccttgtttcagataccacagacctg

SEQ ID NO: 120097 - DNA, 25 bp, mus musculus
gaaacagctaccaatacacttggat

SEQ ID NO: 120098 - DNA, 25 bp, mus musculus
acagctaccaatacacttggattgg

SEQ ID NO: 120099 - DNA, 25 bp, mus musculus
aatacacttggattgggctccatga

SEQ ID NO: 120100 - DNA, 25 bp, mus musculus
ggaacccatctactgccttagaccg

SEQ ID NO: 120101 - DNA, 25 bp, mus musculus
catctactgccttagaccgtgcttt

SEQ ID NO: 120102 - DNA, 25 bp, mus musculus
ccttagaccgtgctttctgtggcag

SEQ ID NO: 120103 - DNA, 25 bp, mus musculus
tagaccgtgctttctgtggcagctt

SEQ ID NO: 120104 - DNA, 25 bp, mus musculus
tctgtggcagcttgtcaagagcttc

SEQ ID NO: 120105 - DNA, 25 bp, mus musculus
tgaagttgccctatgtctgcaaatt

SEQ ID NO: 120106 - DNA, 25 bp, mus musculus
tgccctatgtctgcaaatttactgg

SEQ ID NO: 120107 - DNA, 25 bp, mus musculus
agataccacagacctggtttgatgc

SEQ ID NO: 120108 - DNA, 25 bp, mus musculus
taccacagacctggtttgatgcaga

SEQ ID NO: 120109 - DNA, 25 bp, mus musculus
aactggcctgccaaaagaggcctgg

SEQ ID NO: 120110 - DNA, 25 bp, mus musculus
acctcgtatctgtgctcaatagcgc

SEQ ID NO: 120111 - DNA, 25 bp, mus musculus
tcgtatctgtgctcaatagcgctga

SEQ ID NO: 120112 - DNA, 25 bp, mus musculus
tatctgtgctcaatagcgctgaggc

SEQ ID NO: 120113 - DNA, 25 bp, mus musculus
atagcgctgaggcttcattcttgtc

SEQ ID NO: 120114 - DNA, 25 bp, mus musculus
cttcattcttgtcctccatggtgaa

SEQ ID NO: 120115 - DNA, 25 bp, mus musculus
ctcctcaactatttctctttgacca

SEQ ID NO: 120116 - DNA, 25 bp, mus musculus
ttattctttctgactaattagccaa

SEQ ID NO: 120117 - DNA, 25 bp, mus musculus
tccgggccagcgctttaacagcagg

SEQ ID NO: 120118 - DNA, 25 bp, mus musculus
ctttaacagcaggccagacagcact

SEQ ID NO: 120119 - DNA, 25 bp, mus musculus
cagcaggccagacagcactcgaatg

SEQ ID NO: 120120 - DNA, 25 bp, mus musculus
cagcactcgaatgtgtcaggtagta

SEQ ID NO: 120121 - DNA, 25 bp, mus musculus
aacaggctgtccctgaaagaaagca

SEQ ID NO: 120122 - DNA, 25 bp, mus musculus
gacttgacactggtcttccctatac

SEQ ID NO: 120123 - DNA, 25 bp, mus musculus
gtcttccctatacagctgaaaactg

SEQ ID NO: 120124 - DNA, 25 bp, mus musculus
caaataactcgctcatttatagttt

SEQ ID NO: 120125 - DNA, 25 bp, mus musculus
atagtttatcactgtctaattgcat

SEQ ID NO: 120126 - DNA, 25 bp, mus musculus
tatcactgtctaattgcatatgaat

SEQ ID NO: 120127 - DNA, 25 bp, mus musculus
actaattagccaagactgtgattgc

SEQ ID NO: 120128 - DNA, 25 bp, mus musculus
tagccaagactgtgattgcggggtt

SEQ ID NO: 120129 - DNA, 25 bp, mus musculus
agactgtgattgcggggttgtatct

SEQ ID NO: 120130 - DNA, 25 bp, mus musculus
acagccaagcggctgactgaactca

SEQ ID NO: 120131 - DNA, 25 bp, mus musculus
ctgactgaactcagattgtagcttg

SEQ ID NO: 120132 - DNA, 25 bp, mus musculus
tagcttgtacctttacttcactgac

SEQ ID NO: 120133 - DNA, 25 bp, mus musculus
ttacttcactgaccaataagaaaca

SEQ ID NO: 120134 - DNA, 25 bp, mus musculus
agtgaccccgggagtgctgctgatg

SEQ ID NO: 120135 - DNA, 25 bp, mus musculus
ctgcagtttcagctccactgagcca

SEQ ID NO: 120136 - DNA, 25 bp, mus musculus
gcagtttcagctccactgagccatc

SEQ ID NO: 120137 - DNA, 25 bp, mus musculus
tccactgagccatcataggaagcag

SEQ ID NO: 120138 - DNA, 25 bp, mus musculus
ccactgagccatcataggaagcagg

SEQ ID NO: 120139 - DNA, 25 bp, mus musculus
cactgagccatcataggaagcaggg

SEQ ID NO: 120140 - DNA, 25 bp, mus musculus
tcttttcttccgttctcgcggatct

SEQ ID NO: 120141 - DNA, 25 bp, mus musculus
tttcttccgttctcgcggatctcct

SEQ ID NO: 120142 - DNA, 25 bp, mus musculus
tcgcggatctcctggaggaaaacct

SEQ ID NO: 120143 - DNA, 25 bp, mus musculus
agagccgtgaggtcacaggtcagca

SEQ ID NO: 120144 - DNA, 25 bp, mus musculus
tgaggtcacaggtcagcaggatggt

SEQ ID NO: 120145 - DNA, 25 bp, mus musculus
aggtcacaggtcagcaggatggtga

SEQ ID NO: 120146 - DNA, 25 bp, mus musculus
tcacaggtcagcaggatggtgagga

SEQ ID NO: 120147 - DNA, 25 bp, mus musculus
cagtttcagctccactgagccatca

SEQ ID NO: 120148 - DNA, 25 bp, mus musculus
agtttcagctccactgagccatcat

SEQ ID NO: 120149 - DNA, 25 bp, mus musculus
gtttcagctccactgagccatcata

SEQ ID NO: 120150 - DNA, 25 bp, mus musculus
ttcagctccactgagccatcatagg

SEQ ID NO: 120151 - DNA, 25 bp, mus musculus
tcagctccactgagccatcatagga

SEQ ID NO: 120152 - DNA, 25 bp, mus musculus
cagctccactgagccatcataggaa

SEQ ID NO: 120153 - DNA, 25 bp, mus musculus
agctccactgagccatcataggaag

SEQ ID NO: 120154 - DNA, 25 bp, mus musculus
ctccactgagccatcataggaagca

SEQ ID NO: 120155 - DNA, 25 bp, mus musculus
aaggagtctctcatggggtatagac

SEQ ID NO: 120156 - DNA, 25 bp, mus musculus
gagtctctcatggggtatagactca

SEQ ID NO: 120157 - DNA, 25 bp, mus musculus
aggatcctgtgggcactgctgggtc

SEQ ID NO: 120158 - DNA, 25 bp, mus musculus
tgggcactgctgggtccactctgca

SEQ ID NO: 120159 - DNA, 25 bp, mus musculus
gcactgctgggtccactctgcaaat

SEQ ID NO: 120160 - DNA, 25 bp, mus musculus
ctgctgggtccactctgcaaatgcc

SEQ ID NO: 120161 - DNA, 25 bp, mus musculus
ccactctgcaaatgccaagactatc

SEQ ID NO: 120162 - DNA, 25 bp, mus musculus
ctctgcaaatgccaagactatcaaa

SEQ ID NO: 120163 - DNA, 25 bp, mus musculus
catctgtgagtttgcctcggctagc

SEQ ID NO: 120164 - DNA, 25 bp, mus musculus
tgagtttgcctcggctagccttgct

SEQ ID NO: 120165 - DNA, 25 bp, mus musculus
tcacacaccttgtatatgtaagttc

SEQ ID NO: 120166 - DNA, 25 bp, mus musculus
ctcaaagccagccgtaagtctatgg

SEQ ID NO: 120167 - DNA, 25 bp, mus musculus
tctctcatggggtatagactcacag

SEQ ID NO: 120168 - DNA, 25 bp, mus musculus
tatagactcacaggagaggcccagg

SEQ ID NO: 120169 - DNA, 25 bp, mus musculus
aggcctgctggtggtaaagaaactg

SEQ ID NO: 120170 - DNA, 25 bp, mus musculus
cttttaggcagtttttctgcattga

SEQ ID NO: 120171 - DNA, 25 bp, mus musculus
attagctaatactaaccacatagaa

SEQ ID NO: 120172 - DNA, 25 bp, mus musculus
agctaatactaaccacatagaatat

SEQ ID NO: 120173 - DNA, 25 bp, mus musculus
taaccacatagaatatcagacttag

SEQ ID NO: 120174 - DNA, 25 bp, mus musculus
ataaggatcctgtgggcactgctgg

SEQ ID NO: 120175 - DNA, 25 bp, mus musculus
gtatcttcactcagagttcctttag

SEQ ID NO: 120176 - DNA, 25 bp, mus musculus
tcactcagagttcctttagcttgca

SEQ ID NO: 120177 - DNA, 25 bp, mus musculus
tactccatcaccagaaagacagagt

SEQ ID NO: 120178 - DNA, 25 bp, mus musculus
ggcaattcctgaacatcatagagcg

SEQ ID NO: 120179 - DNA, 25 bp, mus musculus
aattcctgaacatcatagagcgcta

SEQ ID NO: 120180 - DNA, 25 bp, mus musculus
acatcatagagcgctacgatgtttt

SEQ ID NO: 120181 - DNA, 25 bp, mus musculus
tcatagagcgctacgatgttttcat

SEQ ID NO: 120182 - DNA, 25 bp, mus musculus
gctacgatgttttcatgctgaagct

SEQ ID NO: 120183 - DNA, 25 bp, mus musculus
ttttcatgctgaagctcctttaaga

SEQ ID NO: 120184 - DNA, 25 bp, mus musculus
tgctgaagctcctttaagattttta

SEQ ID NO: 120185 - DNA, 25 bp, mus musculus
atttcctttccaagcagaatttgtg

SEQ ID NO: 120186 - DNA, 25 bp, mus musculus
tcccaatcagttttctggcggtgcg

SEQ ID NO: 120187 - DNA, 25 bp, mus musculus
agagttcctttagcttgcaaataat

SEQ ID NO: 120188 - DNA, 25 bp, mus musculus
gttcctttagcttgcaaataatctg

SEQ ID NO: 120189 - DNA, 25 bp, mus musculus
gcttgcaaataatctgccaggtctc

SEQ ID NO: 120190 - DNA, 25 bp, mus musculus
tgcaaataatctgccaggtctccac

SEQ ID NO: 120191 - DNA, 25 bp, mus musculus
tctgccaggtctccaccattgcaat

SEQ ID NO: 120192 - DNA, 25 bp, mus musculus
gccaggtctccaccattgcaatact

SEQ ID NO: 120193 - DNA, 25 bp, mus musculus
aggtctccaccattgcaatactcca

SEQ ID NO: 120194 - DNA, 25 bp, mus musculus
ttgcaatactccatcaccagaaaga

SEQ ID NO: 120195 - DNA, 25 bp, mus musculus
accagtcgctctgagctcatcactt

SEQ ID NO: 120196 - DNA, 25 bp, mus musculus
cgctctgagctcatcacttgacact

SEQ ID NO: 120197 - DNA, 25 bp, mus musculus
cagtggcttcgtcaccttcatcaag

SEQ ID NO: 120198 - DNA, 25 bp, mus musculus
cttcgtcaccttcatcaaggtgaag

SEQ ID NO: 120199 - DNA, 25 bp, mus musculus
agcagaatcctgcaactacagagaa

SEQ ID NO: 120200 - DNA, 25 bp, mus musculus
aaagtgctttccctcaacatgaagc

SEQ ID NO: 120201 - DNA, 25 bp, mus musculus
ctttccctcaacatgaagccaacta

SEQ ID NO: 120202 - DNA, 25 bp, mus musculus
ataccttctatgcagagagaaatgc

SEQ ID NO: 120203 - DNA, 25 bp, mus musculus
acctagactcccagactcaaaatgc

SEQ ID NO: 120204 - DNA, 25 bp, mus musculus
actcccagactcaaaatgcctagta

SEQ ID NO: 120205 - DNA, 25 bp, mus musculus
atccttggctataggcaaagcaggt

SEQ ID NO: 120206 - DNA, 25 bp, mus musculus
tgttctgctgctccagccctactca

SEQ ID NO: 120207 - DNA, 25 bp, mus musculus
atcacttgacacttacacatgtgtg

SEQ ID NO: 120208 - DNA, 25 bp, mus musculus
gccctcatcattccataagcatgct

SEQ ID NO: 120209 - DNA, 25 bp, mus musculus
tgacacttacacatgtgtggtggaa

SEQ ID NO: 120210 - DNA, 25 bp, mus musculus
ttacacatgtgtggtggaacatgag

SEQ ID NO: 120211 - DNA, 25 bp, mus musculus
acatgaggcctcaaagacaaagctt

SEQ ID NO: 120212 - DNA, 25 bp, mus musculus
aaagcttaatgccagcaagagccta

SEQ ID NO: 120213 - DNA, 25 bp, mus musculus
cagctacatggacttagaggaggag

SEQ ID NO: 120214 - DNA, 25 bp, mus musculus
cctgctcacactgctctacagtggc

SEQ ID NO: 120215 - DNA, 25 bp, mus musculus
gctctacagtggcttcgtcaccttc

SEQ ID NO: 120216 - DNA, 25 bp, mus musculus
taccccctgtatgatatctcagcaa

SEQ ID NO: 120217 - DNA, 25 bp, mus musculus
cccctgtatgatatctcagcaactg

SEQ ID NO: 120218 - DNA, 25 bp, mus musculus
caagcacggacctcctacattgccg

SEQ ID NO: 120219 - DNA, 25 bp, mus musculus
acctcctacattgccgaggagatcc

SEQ ID NO: 120220 - DNA, 25 bp, mus musculus
tcctacattgccgaggagatccagt

SEQ ID NO: 120221 - DNA, 25 bp, mus musculus
atccagtggggacaccgcttcgtgt

SEQ ID NO: 120222 - DNA, 25 bp, mus musculus
caccgcttcgtgtcaattgtgactg

SEQ ID NO: 120223 - DNA, 25 bp, mus musculus
cgcttcgtgtcaattgtgactgagg

SEQ ID NO: 120224 - DNA, 25 bp, mus musculus
ttcgtgtcaattgtgactgaggagg

SEQ ID NO: 120225 - DNA, 25 bp, mus musculus
gtgtactctgtggactattccaaat

SEQ ID NO: 120226 - DNA, 25 bp, mus musculus
agagtggctgcgccaagatgcagtg

SEQ ID NO: 120227 - DNA, 25 bp, mus musculus
gcgccaagatgcagtgcccgggagc

SEQ ID NO: 120228 - DNA, 25 bp, mus musculus
tatgatatctcagcaactgaccttg

SEQ ID NO: 120229 - DNA, 25 bp, mus musculus
gatatctcagcaactgaccttgcca

SEQ ID NO: 120230 - DNA, 25 bp, mus musculus
atctcagcaactgaccttgccaatc

SEQ ID NO: 120231 - DNA, 25 bp, mus musculus
actgaccttgccaatcaagacctgg

SEQ ID NO: 120232 - DNA, 25 bp, mus musculus
gaccttgccaatcaagacctggagg

SEQ ID NO: 120233 - DNA, 25 bp, mus musculus
gccaatcaagacctggaggtcatag

SEQ ID NO: 120234 - DNA, 25 bp, mus musculus
acaggcatcaccacacaagcacgga

SEQ ID NO: 120235 - DNA, 25 bp, mus musculus
acacaagcacggacctcctacattg

SEQ ID NO: 120236 - DNA, 25 bp, mus musculus
aatatcgctatcacaatcaatgtag

SEQ ID NO: 120237 - DNA, 25 bp, mus musculus
gtagtcatactgtccatctgattga

SEQ ID NO: 120238 - DNA, 25 bp, mus musculus
gaatcacagtcacgttatgtcgcat

SEQ ID NO: 120239 - DNA, 25 bp, mus musculus
tcacagtcacgttatgtcgcatccc

SEQ ID NO: 120240 - DNA, 25 bp, mus musculus
cagtcacgttatgtcgcatccctga

SEQ ID NO: 120241 - DNA, 25 bp, mus musculus
tgcgagcagccatctctcgagactg

SEQ ID NO: 120242 - DNA, 25 bp, mus musculus
ccatctctcgagactggtggataac

SEQ ID NO: 120243 - DNA, 25 bp, mus musculus
tctctcgagactggtggataactcc

SEQ ID NO: 120244 - DNA, 25 bp, mus musculus
ggtggataactcccacaagagacga

SEQ ID NO: 120245 - DNA, 25 bp, mus musculus
ggataactcccacaagagacgagta

SEQ ID NO: 120246 - DNA, 25 bp, mus musculus
tagataatcctatcaagtcgtctgt

SEQ ID NO: 120247 - DNA, 25 bp, mus musculus
ataatcctatcaagtcgtctgtgta

SEQ ID NO: 120248 - DNA, 25 bp, mus musculus
atactgtccatctgattgagctcag

SEQ ID NO: 120249 - DNA, 25 bp, mus musculus
tccatctgattgagctcagcttcct

SEQ ID NO: 120250 - DNA, 25 bp, mus musculus
atctgattgagctcagcttcctctg

SEQ ID NO: 120251 - DNA, 25 bp, mus musculus
gcttcctctgacatctgcgcagcat

SEQ ID NO: 120252 - DNA, 25 bp, mus musculus
tctgacatctgcgcagcatctcttc

SEQ ID NO: 120253 - DNA, 25 bp, mus musculus
cttgaggtcctcttcatagaatcac

SEQ ID NO: 120254 - DNA, 25 bp, mus musculus
gtcctcttcatagaatcacagtcac

SEQ ID NO: 120255 - DNA, 25 bp, mus musculus
ctcttcatagaatcacagtcacgtt

SEQ ID NO: 120256 - DNA, 25 bp, mus musculus
gcaccttaactggcacaattgccaa

SEQ ID NO: 120257 - DNA, 25 bp, mus musculus
taactggcacaattgccaaagtcac

SEQ ID NO: 120258 - DNA, 25 bp, mus musculus
tgacaagcgtgttgcgtgtatcagc

SEQ ID NO: 120259 - DNA, 25 bp, mus musculus
gtgaccagtactcctgcatggtggg

SEQ ID NO: 120260 - DNA, 25 bp, mus musculus
cctgcatggtgggccacgaggcctt

SEQ ID NO: 120261 - DNA, 25 bp, mus musculus
tgcccatgaacttcacccagaagac

SEQ ID NO: 120262 - DNA, 25 bp, mus musculus
tgaacttcacccagaagaccatcga

SEQ ID NO: 120263 - DNA, 25 bp, mus musculus
tcacccagaagaccatcgaccgtct

SEQ ID NO: 120264 - DNA, 25 bp, mus musculus
gtaaacccaccaatgtcagcgtgtc

SEQ ID NO: 120265 - DNA, 25 bp, mus musculus
atgtcagcgtgtctgtgatcatgtc

SEQ ID NO: 120266 - DNA, 25 bp, mus musculus
ctactcctagaataaactctgtgct

SEQ ID NO: 120267 - DNA, 25 bp, mus musculus
aaagtatccctgcacttccacccag

SEQ ID NO: 120268 - DNA, 25 bp, mus musculus
aggagctggccctgaatgagctctt

SEQ ID NO: 120269 - DNA, 25 bp, mus musculus
tggccctgaatgagctcttgtccct

SEQ ID NO: 120270 - DNA, 25 bp, mus musculus
tgaatgagctcttgtccctgacatg

SEQ ID NO: 120271 - DNA, 25 bp, mus musculus
agctcttgtccctgacatgcctggt

SEQ ID NO: 120272 - DNA, 25 bp, mus musculus
tgacatgcctggtgcgagctttcaa

SEQ ID NO: 120273 - DNA, 25 bp, mus musculus
tgcgagctttcaaccctaaagaagt

SEQ ID NO: 120274 - DNA, 25 bp, mus musculus
agctgtccccagaaagctacctagt

SEQ ID NO: 120275 - DNA, 25 bp, mus musculus
tgtttgagcccctaaaggagccagg

SEQ ID NO: 120276 - DNA, 25 bp, mus musculus
aggcagacttgtgcaacttgctttg

SEQ ID NO: 120277 - DNA, 25 bp, mus musculus
cagacttgtgcaacttgctttggtg

SEQ ID NO: 120278 - DNA, 25 bp, mus musculus
acttgcagcactccaaatacagtgc

SEQ ID NO: 120279 - DNA, 25 bp, mus musculus
actccaaatacagtgcttcacatca

SEQ ID NO: 120280 - DNA, 25 bp, mus musculus
ccaaatacagtgcttcacatcagct

SEQ ID NO: 120281 - DNA, 25 bp, mus musculus
acagtgcttcacatcagctcgcttc

SEQ ID NO: 120282 - DNA, 25 bp, mus musculus
cttcacatcagctcgcttctcgcgt

SEQ ID NO: 120283 - DNA, 25 bp, mus musculus
ttattactgaccatatgcccaatca

SEQ ID NO: 120284 - DNA, 25 bp, mus musculus
ttactgaccatatgcccaatcaatg

SEQ ID NO: 120285 - DNA, 25 bp, mus musculus
ctgaccatatgcccaatcaatgagg

SEQ ID NO: 120286 - DNA, 25 bp, mus musculus
atatgcccaatcaatgaggtgaaga

SEQ ID NO: 120287 - DNA, 25 bp, mus musculus
ctgcatttccataaacttccaagcc

SEQ ID NO: 120288 - DNA, 25 bp, mus musculus
tgttttattgccacagatgatatca

SEQ ID NO: 120289 - DNA, 25 bp, mus musculus
ctcctttcttgtgatgatgtaaaca

SEQ ID NO: 120290 - DNA, 25 bp, mus musculus
gagctgtattcaactctggaatgct

SEQ ID NO: 120291 - DNA, 25 bp, mus musculus
ctgtattcaactctggaatgcttcg

SEQ ID NO: 120292 - DNA, 25 bp, mus musculus
tcaactctggaatgcttcgaaaata

SEQ ID NO: 120293 - DNA, 25 bp, mus musculus
ttcgaaaatatcttcaccaagtcct

SEQ ID NO: 120294 - DNA, 25 bp, mus musculus
atcttcaccaagtcctatcttaaag

SEQ ID NO: 120295 - DNA, 25 bp, mus musculus
aatgttacttgcagcactccaaata

SEQ ID NO: 120296 - DNA, 25 bp, mus musculus
gttacttgcagcactccaaatacag

SEQ ID NO: 120297 - DNA, 25 bp, mus musculus
cccagagtgcccataacacagaacc

SEQ ID NO: 120298 - DNA, 25 bp, mus musculus
gagtgcccataacacagaacccctg

SEQ ID NO: 120299 - DNA, 25 bp, mus musculus
tcaaagagtgtcccccatgcgcagc

SEQ ID NO: 120300 - DNA, 25 bp, mus musculus
caaagagtgtcccccatgcgcagct

SEQ ID NO: 120301 - DNA, 25 bp, mus musculus
agagtgtcccccatgcgcagctcca

SEQ ID NO: 120302 - DNA, 25 bp, mus musculus
agtgtcccccatgcgcagctccaga

SEQ ID NO: 120303 - DNA, 25 bp, mus musculus
gaccagcaatgggcgtacagagcaa

SEQ ID NO: 120304 - DNA, 25 bp, mus musculus
accagcaatgggcgtacagagcaaa

SEQ ID NO: 120305 - DNA, 25 bp, mus musculus
ccagcaatgggcgtacagagcaaaa

SEQ ID NO: 120306 - DNA, 25 bp, mus musculus
cagcaatgggcgtacagagcaaaac

SEQ ID NO: 120307 - DNA, 25 bp, mus musculus
agcaatgggcgtacagagcaaaact

SEQ ID NO: 120308 - DNA, 25 bp, mus musculus
caatgggcgtacagagcaaaactac

SEQ ID NO: 120309 - DNA, 25 bp, mus musculus
agtgcccataacacagaacccctgt

SEQ ID NO: 120310 - DNA, 25 bp, mus musculus
gtgcccataacacagaacccctgtc

SEQ ID NO: 120311 - DNA, 25 bp, mus musculus
ctccactcaaagagtgtcccccatg

SEQ ID NO: 120312 - DNA, 25 bp, mus musculus
tccactcaaagagtgtcccccatgc

SEQ ID NO: 120313 - DNA, 25 bp, mus musculus
ccactcaaagagtgtcccccatgcg

SEQ ID NO: 120314 - DNA, 25 bp, mus musculus
cactcaaagagtgtcccccatgcgc

SEQ ID NO: 120315 - DNA, 25 bp, mus musculus
actcaaagagtgtcccccatgcgca

SEQ ID NO: 120316 - DNA, 25 bp, mus musculus
ctcaaagagtgtcccccatgcgcag

SEQ ID NO: 120317 - DNA, 25 bp, mus musculus
agcgcaataaccacatcatcgaact

SEQ ID NO: 120318 - DNA, 25 bp, mus musculus
ataaccacatcatcgaacttcatca

SEQ ID NO: 120319 - DNA, 25 bp, mus musculus
atcttgcctgtcatgaagctgcatg

SEQ ID NO: 120320 - DNA, 25 bp, mus musculus
ttgcctgtcatgaagctgcatgaga

SEQ ID NO: 120321 - DNA, 25 bp, mus musculus
cctgtcatgaagctgcatgagacaa

SEQ ID NO: 120322 - DNA, 25 bp, mus musculus
aagctgcatgagacaacccgtgcat

SEQ ID NO: 120323 - DNA, 25 bp, mus musculus
ctgcatgagacaacccgtgcatggc

SEQ ID NO: 120324 - DNA, 25 bp, mus musculus
catgagacaacccgtgcatggcaca

SEQ ID NO: 120325 - DNA, 25 bp, mus musculus
acaacccgtgcatggcacagtcatc

SEQ ID NO: 120326 - DNA, 25 bp, mus musculus
cgtgcatggcacagtcatcaagctg

SEQ ID NO: 120327 - DNA, 25 bp, mus musculus
cacagtcatcaagctgtggatttga

SEQ ID NO: 120328 - DNA, 25 bp, mus musculus
agtcatcaagctgtggatttgagca

SEQ ID NO: 120329 - DNA, 25 bp, mus musculus
accacatcatcgaacttcatcaatc

SEQ ID NO: 120330 - DNA, 25 bp, mus musculus
acatcatcgaacttcatcaatctag

SEQ ID NO: 120331 - DNA, 25 bp, mus musculus
tcatcgaacttcatcaatctaggag

SEQ ID NO: 120332 - DNA, 25 bp, mus musculus
aacttcatcaatctaggagagaacc

SEQ ID NO: 120333 - DNA, 25 bp, mus musculus
ttcatcaatctaggagagaacctga

SEQ ID NO: 120334 - DNA, 25 bp, mus musculus
gagaacctgaaccgagcaaaaggat

SEQ ID NO: 120335 - DNA, 25 bp, mus musculus
aggacctggacacaaacaggacaat

SEQ ID NO: 120336 - DNA, 25 bp, mus musculus
ttgatcttgcctgtcatgaagctgc

SEQ ID NO: 120337 - DNA, 25 bp, mus musculus
agggtaaacttcagcctcatgagtt

SEQ ID NO: 120338 - DNA, 25 bp, mus musculus
gtaaacttcagcctcatgagttcca

SEQ ID NO: 120339 - DNA, 25 bp, mus musculus
ttctggcaatcggtgcttcatagga

SEQ ID NO: 120340 - DNA, 25 bp, mus musculus
tggcaatcggtgcttcataggataa

SEQ ID NO: 120341 - DNA, 25 bp, mus musculus
aggataaactgatcccagcagataa

SEQ ID NO: 120342 - DNA, 25 bp, mus musculus
aactgatcccagcagataatgagaa

SEQ ID NO: 120343 - DNA, 25 bp, mus musculus
tgatgtccgttacactcagctgtga

SEQ ID NO: 120344 - DNA, 25 bp, mus musculus
tgtccgttacactcagctgtgatca

SEQ ID NO: 120345 - DNA, 25 bp, mus musculus
ttacactcagctgtgatcatcgagt

SEQ ID NO: 120346 - DNA, 25 bp, mus musculus
cactcagctgtgatcatcgagttgt

SEQ ID NO: 120347 - DNA, 25 bp, mus musculus
tcagctgtgatcatcgagttgtgga

SEQ ID NO: 120348 - DNA, 25 bp, mus musculus
gagcccagtggcttgctgaattcaa

SEQ ID NO: 120349 - DNA, 25 bp, mus musculus
aacttcagcctcatgagttccaggg

SEQ ID NO: 120350 - DNA, 25 bp, mus musculus
catttacaatctccaacttagggat

SEQ ID NO: 120351 - DNA, 25 bp, mus musculus
ttacaatctccaacttagggatgtt

SEQ ID NO: 120352 - DNA, 25 bp, mus musculus
atttctctgcaattagtagtccacc

SEQ ID NO: 120353 - DNA, 25 bp, mus musculus
caattagtagtccacctcaggcatg

SEQ ID NO: 120354 - DNA, 25 bp, mus musculus
gtagtccacctcaggcatgtattct

SEQ ID NO: 120355 - DNA, 25 bp, mus musculus
cacctcaggcatgtattctggcaat

SEQ ID NO: 120356 - DNA, 25 bp, mus musculus
gtattctggcaatcggtgcttcata

SEQ ID NO: 120357 - DNA, 25 bp, mus musculus
tctgacccatccacaggcaatcaca

SEQ ID NO: 120358 - DNA, 25 bp, mus musculus
ccacaggcaatcacacacagagaaa

SEQ ID NO: 120359 - DNA, 25 bp, mus musculus
cccagtcctaagctctctaccatag

SEQ ID NO: 120360 - DNA, 25 bp, mus musculus
agactcccaggctagacagaggtcc

SEQ ID NO: 120361 - DNA, 25 bp, mus musculus
ctcccaggctagacagaggtcctaa

SEQ ID NO: 120362 - DNA, 25 bp, mus musculus
tcccaggctagacagaggtcctaag

SEQ ID NO: 120363 - DNA, 25 bp, mus musculus
caggctagacagaggtcctaagctc

SEQ ID NO: 120364 - DNA, 25 bp, mus musculus
ggctagacagaggtcctaagctctc

SEQ ID NO: 120365 - DNA, 25 bp, mus musculus
gctagacagaggtcctaagctctct

SEQ ID NO: 120366 - DNA, 25 bp, mus musculus
tagacagaggtcctaagctctctac

SEQ ID NO: 120367 - DNA, 25 bp, mus musculus
agacagaggtcctaagctctctacc

SEQ ID NO: 120368 - DNA, 25 bp, mus musculus
acagaggtcctaagctctctaccat

SEQ ID NO: 120369 - DNA, 25 bp, mus musculus
cacacacagagaaaaacagcttcca

SEQ ID NO: 120370 - DNA, 25 bp, mus musculus
cagagaaaaacagcttccagccaag

SEQ ID NO: 120371 - DNA, 25 bp, mus musculus
agagaaaaacagcttccagccaagg

SEQ ID NO: 120372 - DNA, 25 bp, mus musculus
agccaaggcttcgcccagtcctaag

SEQ ID NO: 120373 - DNA, 25 bp, mus musculus
gccaaggcttcgcccagtcctaagc

SEQ ID NO: 120374 - DNA, 25 bp, mus musculus
caaggcttcgcccagtcctaagctc

SEQ ID NO: 120375 - DNA, 25 bp, mus musculus
gcttcgcccagtcctaagctctcta

SEQ ID NO: 120376 - DNA, 25 bp, mus musculus
gcccagtcctaagctctctaccata

SEQ ID NO: 120377 - DNA, 25 bp, mus musculus
atcagactccggcaacgcgccaatc

SEQ ID NO: 120378 - DNA, 25 bp, mus musculus
caacgcgccaatccggacagtcggc

SEQ ID NO: 120379 - DNA, 25 bp, mus musculus
accactggactacacgtcctgtatg

SEQ ID NO: 120380 - DNA, 25 bp, mus musculus
actggactacacgtcctgtatgcgc

SEQ ID NO: 120381 - DNA, 25 bp, mus musculus
ggactacacgtcctgtatgcgccag

SEQ ID NO: 120382 - DNA, 25 bp, mus musculus
cacgtcctgtatgcgccagggagat

SEQ ID NO: 120383 - DNA, 25 bp, mus musculus
gtcctgtatgcgccagggagatgat

SEQ ID NO: 120384 - DNA, 25 bp, mus musculus
agaacttcggtcagctatgctccta

SEQ ID NO: 120385 - DNA, 25 bp, mus musculus
acttcggtcagctatgctcctatgt

SEQ ID NO: 120386 - DNA, 25 bp, mus musculus
tcggtcagctatgctcctatgtgct

SEQ ID NO: 120387 - DNA, 25 bp, mus musculus
agctatgctcctatgtgctacgact

SEQ ID NO: 120388 - DNA, 25 bp, mus musculus
tggagtctcagttcagccaagtggt

SEQ ID NO: 120389 - DNA, 25 bp, mus musculus
gccaatccggacagtcggctcctga

SEQ ID NO: 120390 - DNA, 25 bp, mus musculus
ctcagttcagccaagtggtgtggat

SEQ ID NO: 120391 - DNA, 25 bp, mus musculus
agtcgtgcctgcatggagatcaagc

SEQ ID NO: 120392 - DNA, 25 bp, mus musculus
atcaagccagtggactacagatggg

SEQ ID NO: 120393 - DNA, 25 bp, mus musculus
tacagatgggcagtacctggtccgc

SEQ ID NO: 120394 - DNA, 25 bp, mus musculus
cctggtccgcttaagctcaccactg

SEQ ID NO: 120395 - DNA, 25 bp, mus musculus
ccgcttaagctcaccactggactac

SEQ ID NO: 120396 - DNA, 25 bp, mus musculus
cttaagctcaccactggactacacg

SEQ ID NO: 120397 - DNA, 25 bp, mus musculus
aagctcaccactggactacacgtcc

SEQ ID NO: 120398 - DNA, 25 bp, mus musculus
taaagacgatggccactctgacagc

SEQ ID NO: 120399 - DNA, 25 bp, mus musculus
aagacgatggccactctgacagcac

SEQ ID NO: 120400 - DNA, 25 bp, mus musculus
tctgctcctgcttctcagatacaag

SEQ ID NO: 120401 - DNA, 25 bp, mus musculus
tgctcctgcttctcagatacaagcc

SEQ ID NO: 120402 - DNA, 25 bp, mus musculus
tacggcctcctggaccacctacagg

SEQ ID NO: 120403 - DNA, 25 bp, mus musculus
ctccattcctgagaccacctggaat

SEQ ID NO: 120404 - DNA, 25 bp, mus musculus
ccattcctgagaccacctggaatgc

SEQ ID NO: 120405 - DNA, 25 bp, mus musculus
tcctgagaccacctggaatgccagg

SEQ ID NO: 120406 - DNA, 25 bp, mus musculus
ctgagaccacctggaatgccaggaa

SEQ ID NO: 120407 - DNA, 25 bp, mus musculus
gagaccacctggaatgccaggaatc

SEQ ID NO: 120408 - DNA, 25 bp, mus musculus
gaccacctggaatgccaggaatccg

SEQ ID NO: 120409 - DNA, 25 bp, mus musculus
ggaatgccaggaatccgagggcctt

SEQ ID NO: 120410 - DNA, 25 bp, mus musculus
gacgatggccactctgacagcacgg

SEQ ID NO: 120411 - DNA, 25 bp, mus musculus
cgatggccactctgacagcacggct

SEQ ID NO: 120412 - DNA, 25 bp, mus musculus
ggccactctgacagcacggctgcag

SEQ ID NO: 120413 - DNA, 25 bp, mus musculus
actctgacagcacggctgcagcctc

SEQ ID NO: 120414 - DNA, 25 bp, mus musculus
tctgacagcacggctgcagcctctt

SEQ ID NO: 120415 - DNA, 25 bp, mus musculus
agcagcaggctcctccacagtctgc

SEQ ID NO: 120416 - DNA, 25 bp, mus musculus
acagtctgctcctgcttctcagata

SEQ ID NO: 120417 - DNA, 25 bp, mus musculus
agtctgctcctgcttctcagataca

SEQ ID NO: 120418 - DNA, 25 bp, mus musculus
tggcctggcttggaacccattttgc

SEQ ID NO: 120419 - DNA, 25 bp, mus musculus
ggcttggaacccattttgccactct

SEQ ID NO: 120420 - DNA, 25 bp, mus musculus
tcccaatttaaacgcatatctgtct

SEQ ID NO: 120421 - DNA, 25 bp, mus musculus
cgcatatctgtctctgagtgacaca

SEQ ID NO: 120422 - DNA, 25 bp, mus musculus
gtctctgagtgacacatgcgtacat

SEQ ID NO: 120423 - DNA, 25 bp, mus musculus
cacatgcgtacatatacactatgga

SEQ ID NO: 120424 - DNA, 25 bp, mus musculus
atgcgtacatatacactatggatct

SEQ ID NO: 120425 - DNA, 25 bp, mus musculus
cgtacatatacactatggatctgat

SEQ ID NO: 120426 - DNA, 25 bp, mus musculus
acatatacactatggatctgatcga

SEQ ID NO: 120427 - DNA, 25 bp, mus musculus
tatacactatggatctgatcgatct

SEQ ID NO: 120428 - DNA, 25 bp, mus musculus
atacactatggatctgatcgatctc

SEQ ID NO: 120429 - DNA, 25 bp, mus musculus
tacactatggatctgatcgatctct

SEQ ID NO: 120430 - DNA, 25 bp, mus musculus
gaacccattttgccactctctggga

SEQ ID NO: 120431 - DNA, 25 bp, mus musculus
cccattttgccactctctgggaatc

SEQ ID NO: 120432 - DNA, 25 bp, mus musculus
attttgccactctctgggaatcgat

SEQ ID NO: 120433 - DNA, 25 bp, mus musculus
ttgccactctctgggaatcgattct

SEQ ID NO: 120434 - DNA, 25 bp, mus musculus
tgactaagccagcagcggcacaacc

SEQ ID NO: 120435 - DNA, 25 bp, mus musculus
gttagacttaactgtctttgaagca

SEQ ID NO: 120436 - DNA, 25 bp, mus musculus
agacttaactgtctttgaagcaagg

SEQ ID NO: 120437 - DNA, 25 bp, mus musculus
ttttcccaatttaaacgcatatctg

SEQ ID NO: 120438 - DNA, 25 bp, mus musculus
gtattcagactccctgaacatgagc

SEQ ID NO: 120439 - DNA, 25 bp, mus musculus
agactccctgaacatgagcactgtg

SEQ ID NO: 120440 - DNA, 25 bp, mus musculus
taggactatcctagttcgacctgtc

SEQ ID NO: 120441 - DNA, 25 bp, mus musculus
cctagttcgacctgtcaacatcact

SEQ ID NO: 120442 - DNA, 25 bp, mus musculus
tcgacctgtcaacatcactgagccc

SEQ ID NO: 120443 - DNA, 25 bp, mus musculus
tgtcaacatcactgagcccaccttg

SEQ ID NO: 120444 - DNA, 25 bp, mus musculus
tgagcccaccttggagctactccat

SEQ ID NO: 120445 - DNA, 25 bp, mus musculus
ccagctgtactgcttcatttatggc

SEQ ID NO: 120446 - DNA, 25 bp, mus musculus
gctgtactgcttcatttatggccac

SEQ ID NO: 120447 - DNA, 25 bp, mus musculus
gtactgcttcatttatggccacatc

SEQ ID NO: 120448 - DNA, 25 bp, mus musculus
cttcatttatggccacatcctaaat

SEQ ID NO: 120449 - DNA, 25 bp, mus musculus
ttatggccacatcctaaatgatgtc

SEQ ID NO: 120450 - DNA, 25 bp, mus musculus
ggtcaccaccagccaagtgaccagc

SEQ ID NO: 120451 - DNA, 25 bp, mus musculus
ccacatcctaaatgatgtctctgtc

SEQ ID NO: 120452 - DNA, 25 bp, mus musculus
caccaccagccaagtgaccagctgg

SEQ ID NO: 120453 - DNA, 25 bp, mus musculus
gaccagctggggcaagtcagccaag

SEQ ID NO: 120454 - DNA, 25 bp, mus musculus
caagtcagccaagaacttcacatgc

SEQ ID NO: 120455 - DNA, 25 bp, mus musculus
agccaagaacttcacatgccacgtg

SEQ ID NO: 120456 - DNA, 25 bp, mus musculus
atgccacgtgacacatcctccatca

SEQ ID NO: 120457 - DNA, 25 bp, mus musculus
acatcctccatcattcaacgaaagt

SEQ ID NO: 120458 - DNA, 25 bp, mus musculus
tcctccatcattcaacgaaagtagg

SEQ ID NO: 120459 - DNA, 25 bp, mus musculus
agctctccaataaacatagcatgaa

SEQ ID NO: 120460 - DNA, 25 bp, mus musculus
tttacaaatctgttcattctggcta

SEQ ID NO: 120461 - DNA, 25 bp, mus musculus
cccttatcacgttgttcccagtgat

SEQ ID NO: 120462 - DNA, 25 bp, mus musculus
ttatcacgttgttcccagtgatttg

SEQ ID NO: 120463 - DNA, 25 bp, mus musculus
tcacgttgttcccagtgatttgatg

SEQ ID NO: 120464 - DNA, 25 bp, mus musculus
taagtccctccttaggcatcctgca

SEQ ID NO: 120465 - DNA, 25 bp, mus musculus
gtccctccttaggcatcctgcaaga

SEQ ID NO: 120466 - DNA, 25 bp, mus musculus
agtagtcagtcctgttgagttagag

SEQ ID NO: 120467 - DNA, 25 bp, mus musculus
cagtcctgttgagttagagtcctaa

SEQ ID NO: 120468 - DNA, 25 bp, mus musculus
agagtcctaactatacacaatatcg

SEQ ID NO: 120469 - DNA, 25 bp, mus musculus
actatacacaatatcgtgcgatgtt

SEQ ID NO: 120470 - DNA, 25 bp, mus musculus
cacaatatcgtgcgatgtttatata

SEQ ID NO: 120471 - DNA, 25 bp, mus musculus
ctgttcattctggctagccccaaaa

SEQ ID NO: 120472 - DNA, 25 bp, mus musculus
ttcattctggctagccccaaaattc

SEQ ID NO: 120473 - DNA, 25 bp, mus musculus
tagcagagccctttgtcgccaacag

SEQ ID NO: 120474 - DNA, 25 bp, mus musculus
cagagccctttgtcgccaacaggga

SEQ ID NO: 120475 - DNA, 25 bp, mus musculus
gatgtcgcctacgtggaacaactta

SEQ ID NO: 120476 - DNA, 25 bp, mus musculus
caacttatacacacagaaggaaagt

SEQ ID NO: 120477 - DNA, 25 bp, mus musculus
ggtttacagctgccaatcaaacctg

SEQ ID NO: 120478 - DNA, 25 bp, mus musculus
ctctctgtcagcgtaggtaggcact

SEQ ID NO: 120479 - DNA, 25 bp, mus musculus
cttcggcatgatcttcacctgctgc

SEQ ID NO: 120480 - DNA, 25 bp, mus musculus
catgatcttcacctgctgcttgtac

SEQ ID NO: 120481 - DNA, 25 bp, mus musculus
gttgcactactgaccacgatgatgc

SEQ ID NO: 120482 - DNA, 25 bp, mus musculus
agccccactactgaacactactgac

SEQ ID NO: 120483 - DNA, 25 bp, mus musculus
cccactactgaacactactgactta

SEQ ID NO: 120484 - DNA, 25 bp, mus musculus
gaacactactgacttagactgctga

SEQ ID NO: 120485 - DNA, 25 bp, mus musculus
tactgacttagactgctgactgcca

SEQ ID NO: 120486 - DNA, 25 bp, mus musculus
agactgctgactgccagaggtagct

SEQ ID NO: 120487 - DNA, 25 bp, mus musculus
ctgctgactgccagaggtagctacc

SEQ ID NO: 120488 - DNA, 25 bp, mus musculus
agaggtagctaccctcatgccatcg

SEQ ID NO: 120489 - DNA, 25 bp, mus musculus
agctaccctcatgccatcgctacga

SEQ ID NO: 120490 - DNA, 25 bp, mus musculus
cctggcatgccacctcaggggcatg

SEQ ID NO: 120491 - DNA, 25 bp, mus musculus
cttcacctgctgcttgtaccgaagc

SEQ ID NO: 120492 - DNA, 25 bp, mus musculus
atgccacctcaggggcatgcacctt

SEQ ID NO: 120493 - DNA, 25 bp, mus musculus
cacctgctgcttgtaccgaagcctc

SEQ ID NO: 120494 - DNA, 25 bp, mus musculus
cttgtaccgaagcctcaagctggaa

SEQ ID NO: 120495 - DNA, 25 bp, mus musculus
gtaccgaagcctcaagctggaacac

SEQ ID NO: 120496 - DNA, 25 bp, mus musculus
ccgaagcctcaagctggaacactac

SEQ ID NO: 120497 - DNA, 25 bp, mus musculus
cctcaagctggaacactactgacca

SEQ ID NO: 120498 - DNA, 25 bp, mus musculus
gctggaacactactgaccacgatga

SEQ ID NO: 120499 - DNA, 25 bp, mus musculus
gccgttgcactactgaccacgatga

SEQ ID NO: 120500 - DNA, 25 bp, mus musculus
tatcttcttcctgatggcagtggtt

SEQ ID NO: 120501 - DNA, 25 bp, mus musculus
cttcctgatggcagtggttacaggg

SEQ ID NO: 120502 - DNA, 25 bp, mus musculus
caacattaaagacacctatatgcac

SEQ ID NO: 120503 - DNA, 25 bp, mus musculus
taaagacacctatatgcactgggtg

SEQ ID NO: 120504 - DNA, 25 bp, mus musculus
agacacctatatgcactgggtgaag

SEQ ID NO: 120505 - DNA, 25 bp, mus musculus
gattgatcctgcgaatggtaatact

SEQ ID NO: 120506 - DNA, 25 bp, mus musculus
tgatcctgcgaatggtaatactaaa

SEQ ID NO: 120507 - DNA, 25 bp, mus musculus
tactaaatatgacccgaagttccag

SEQ ID NO: 120508 - DNA, 25 bp, mus musculus
atatgacccgaagttccagggcaag

SEQ ID NO: 120509 - DNA, 25 bp, mus musculus
caaggccactataacagcagacaca

SEQ ID NO: 120510 - DNA, 25 bp, mus musculus
ggccactataacagcagacacatcc

SEQ ID NO: 120511 - DNA, 25 bp, mus musculus
tataacagcagacacatcctccaac

SEQ ID NO: 120512 - DNA, 25 bp, mus musculus
ttcagaggttcagctgcagcagtct

SEQ ID NO: 120513 - DNA, 25 bp, mus musculus
tcagctgcagcagtctggggcagag

SEQ ID NO: 120514 - DNA, 25 bp, mus musculus
agagcttgtgaagccaggggcctca

SEQ ID NO: 120515 - DNA, 25 bp, mus musculus
tgtgaagccaggggcctcagtcaag

SEQ ID NO: 120516 - DNA, 25 bp, mus musculus
ggcctcagtcaagttgtcctgcaca

SEQ ID NO: 120517 - DNA, 25 bp, mus musculus
gttgtcctgcacagcttctggcttc

SEQ ID NO: 120518 - DNA, 25 bp, mus musculus
cacagcttctggcttcaacattaaa

SEQ ID NO: 120519 - DNA, 25 bp, mus musculus
cttcaacattaaagacacctatatg

SEQ ID NO: 120520 - DNA, 25 bp, mus musculus
aattgaggcttctgtaagtgagtcc

SEQ ID NO: 120521 - DNA, 25 bp, mus musculus
attgaggcttctgtaagtgagtccc

SEQ ID NO: 120522 - DNA, 25 bp, mus musculus
ggcacgcagctcggaggacatggct

SEQ ID NO: 120523 - DNA, 25 bp, mus musculus
gcacgcagctcggaggacatggctc

SEQ ID NO: 120524 - DNA, 25 bp, mus musculus
ctcggaggacatggctcgggagacc

SEQ ID NO: 120525 - DNA, 25 bp, mus musculus
cttatcacggaccaccactggaaca

SEQ ID NO: 120526 - DNA, 25 bp, mus musculus
tatcacggaccaccactggaacaac

SEQ ID NO: 120527 - DNA, 25 bp, mus musculus
atcacggaccaccactggaacaacg

SEQ ID NO: 120528 - DNA, 25 bp, mus musculus
tcacggaccaccactggaacaacgc

SEQ ID NO: 120529 - DNA, 25 bp, mus musculus
cacggaccaccactggaacaacgcg

SEQ ID NO: 120530 - DNA, 25 bp, mus musculus
accttctggatttgatccgcagaga

SEQ ID NO: 120531 - DNA, 25 bp, mus musculus
gatttgatccgcagagagggcagga

SEQ ID NO: 120532 - DNA, 25 bp, mus musculus
ttgaggcttctgtaagtgagtcccg

SEQ ID NO: 120533 - DNA, 25 bp, mus musculus
agttgtccgagaggatcgaaggctt

SEQ ID NO: 120534 - DNA, 25 bp, mus musculus
ttgtccgagaggatcgaaggcttcg

SEQ ID NO: 120535 - DNA, 25 bp, mus musculus
aggatcgaaggcttcgtggagactc

SEQ ID NO: 120536 - DNA, 25 bp, mus musculus
ggatcgaaggcttcgtggagactct

SEQ ID NO: 120537 - DNA, 25 bp, mus musculus
aaggcttcgtggagactctgaagcg

SEQ ID NO: 120538 - DNA, 25 bp, mus musculus
gcttcgtggagactctgaagcgagg

SEQ ID NO: 120539 - DNA, 25 bp, mus musculus
ttcgtggagactctgaagcgaggtg

SEQ ID NO: 120540 - DNA, 25 bp, mus musculus
gcagctgaccacttggaagcattgg

SEQ ID NO: 120541 - DNA, 25 bp, mus musculus
ttggcagccattgaggactgcttct

SEQ ID NO: 120542 - DNA, 25 bp, mus musculus
ctgatggctttctaccagctggaga

SEQ ID NO: 120543 - DNA, 25 bp, mus musculus
gctttctaccagctggagatcttgg

SEQ ID NO: 120544 - DNA, 25 bp, mus musculus
ttgagctggttcagccaaagagaca

SEQ ID NO: 120545 - DNA, 25 bp, mus musculus
agctggttcagccaaagagacacaa

SEQ ID NO: 120546 - DNA, 25 bp, mus musculus
caaagagacacaactgacgaaggcc

SEQ ID NO: 120547 - DNA, 25 bp, mus musculus
gacacaactgacgaaggccagcagt

SEQ ID NO: 120548 - DNA, 25 bp, mus musculus
actgacgaaggccagcagttacgga

SEQ ID NO: 120549 - DNA, 25 bp, mus musculus
ttcatccagtggctgagagaggcag

SEQ ID NO: 120550 - DNA, 25 bp, mus musculus
tcatccgaagatgactgatggtgac

SEQ ID NO: 120551 - DNA, 25 bp, mus musculus
tggtgactgccagatccgtgcatct

SEQ ID NO: 120552 - DNA, 25 bp, mus musculus
attgaggactgcttcttggaacatg

SEQ ID NO: 120553 - DNA, 25 bp, mus musculus
ctgccagatccgtgcatctcattgg

SEQ ID NO: 120554 - DNA, 25 bp, mus musculus
gactgcttcttggaacatgaaactc

SEQ ID NO: 120555 - DNA, 25 bp, mus musculus
gaaactctcgttacttccatggcca

SEQ ID NO: 120556 - DNA, 25 bp, mus musculus
actctcgttacttccatggccaagg

SEQ ID NO: 120557 - DNA, 25 bp, mus musculus
acttccatggccaaggtcctgatgg

SEQ ID NO: 120558 - DNA, 25 bp, mus musculus
tccatggccaaggtcctgatggctt

SEQ ID NO: 120559 - DNA, 25 bp, mus musculus
atggccaaggtcctgatggctttct

SEQ ID NO: 120560 - DNA, 25 bp, mus musculus
gtcctgatggctttctaccagctgg

SEQ ID NO: 120561 - DNA, 25 bp, mus musculus
tttaacatcattatcttcacagtaa

SEQ ID NO: 120562 - DNA, 25 bp, mus musculus
taacatcattatcttcacagtaaca

SEQ ID NO: 120563 - DNA, 25 bp, mus musculus
cttctgggttcaccttcactgatta

SEQ ID NO: 120564 - DNA, 25 bp, mus musculus
tctgggttcaccttcactgattact

SEQ ID NO: 120565 - DNA, 25 bp, mus musculus
tgggttcaccttcactgattactac

SEQ ID NO: 120566 - DNA, 25 bp, mus musculus
ggttcaccttcactgattactacat

SEQ ID NO: 120567 - DNA, 25 bp, mus musculus
ttcaccttcactgattactacatga

SEQ ID NO: 120568 - DNA, 25 bp, mus musculus
ctgattactacatgaactgggtcca

SEQ ID NO: 120569 - DNA, 25 bp, mus musculus
gattactacatgaactgggtccacc

SEQ ID NO: 120570 - DNA, 25 bp, mus musculus
ttactacatgaactgggtccaccag

SEQ ID NO: 120571 - DNA, 25 bp, mus musculus
actacatgaactgggtccaccagcc

SEQ ID NO: 120572 - DNA, 25 bp, mus musculus
ccaccagcctccagggaaggcactt

SEQ ID NO: 120573 - DNA, 25 bp, mus musculus
acatcattatcttcacagtaacacc

SEQ ID NO: 120574 - DNA, 25 bp, mus musculus
atcattatcttcacagtaacacctt

SEQ ID NO: 120575 - DNA, 25 bp, mus musculus
cattatcttcacagtaacaccttta

SEQ ID NO: 120576 - DNA, 25 bp, mus musculus
atcttcacagtaacacctttaaatg

SEQ ID NO: 120577 - DNA, 25 bp, mus musculus
aaatggtatccagtgtgaggtgaag

SEQ ID NO: 120578 - DNA, 25 bp, mus musculus
atggtatccagtgtgaggtgaagct

SEQ ID NO: 120579 - DNA, 25 bp, mus musculus
gcatcttctgggttcaccttcactg

SEQ ID NO: 120580 - DNA, 25 bp, mus musculus
atcttctgggttcaccttcactgat

SEQ ID NO: 120581 - DNA, 25 bp, mus musculus
ggctgtcttagggctgctcttctgc

SEQ ID NO: 120582 - DNA, 25 bp, mus musculus
gctgctcttctgcctagtgacattc

SEQ ID NO: 120583 - DNA, 25 bp, mus musculus
aggacctggcctattgcagccctca

SEQ ID NO: 120584 - DNA, 25 bp, mus musculus
cctattgcagccctcacagagcctg

SEQ ID NO: 120585 - DNA, 25 bp, mus musculus
attgcagccctcacagagcctgtcc

SEQ ID NO: 120586 - DNA, 25 bp, mus musculus
catcacctgcacagtctctggtttc

SEQ ID NO: 120587 - DNA, 25 bp, mus musculus
cacagtctctggtttctcattaact

SEQ ID NO: 120588 - DNA, 25 bp, mus musculus
taatgcagctttcatatccagactg

SEQ ID NO: 120589 - DNA, 25 bp, mus musculus
gcaatctaatgacacagccatatat

SEQ ID NO: 120590 - DNA, 25 bp, mus musculus
atctaatgacacagccatatattac

SEQ ID NO: 120591 - DNA, 25 bp, mus musculus
catatattactgtgccagaaacaca

SEQ ID NO: 120592 - DNA, 25 bp, mus musculus
ttactgtgccagaaacacagtgagg

SEQ ID NO: 120593 - DNA, 25 bp, mus musculus
gctcttctgcctagtgacattccca

SEQ ID NO: 120594 - DNA, 25 bp, mus musculus
ctgcctagtgacattcccaagctgt

SEQ ID NO: 120595 - DNA, 25 bp, mus musculus
cctagtgacattcccaagctgtgtc

SEQ ID NO: 120596 - DNA, 25 bp, mus musculus
agtgacattcccaagctgtgtccta

SEQ ID NO: 120597 - DNA, 25 bp, mus musculus
cccaagctgtgtcctatcccaggtg

SEQ ID NO: 120598 - DNA, 25 bp, mus musculus
aagctgtgtcctatcccaggtgcag

SEQ ID NO: 120599 - DNA, 25 bp, mus musculus
atcccaggtgcagctgaagcagtca

SEQ ID NO: 120600 - DNA, 25 bp, mus musculus
gtcaggacctggcctattgcagccc

SEQ ID NO: 120601 - DNA, 25 bp, mus musculus
cctgtcgcacggcgctcacaagcag

SEQ ID NO: 120602 - DNA, 25 bp, mus musculus
tgtcgcacggcgctcacaagcagaa

SEQ ID NO: 120603 - DNA, 25 bp, mus musculus
ctcatgcgattcgcaagctgcttag

SEQ ID NO: 120604 - DNA, 25 bp, mus musculus
catgcgattcgcaagctgcttagag

SEQ ID NO: 120605 - DNA, 25 bp, mus musculus
tgcgattcgcaagctgcttagagca

SEQ ID NO: 120606 - DNA, 25 bp, mus musculus
cgattcgcaagctgcttagagcact

SEQ ID NO: 120607 - DNA, 25 bp, mus musculus
attcgcaagctgcttagagcactac

SEQ ID NO: 120608 - DNA, 25 bp, mus musculus
gctgcttagagcactacaccgagtg

SEQ ID NO: 120609 - DNA, 25 bp, mus musculus
tgcttagagcactacaccgagtgcg

SEQ ID NO: 120610 - DNA, 25 bp, mus musculus
cttagagcactacaccgagtgcgga

SEQ ID NO: 120611 - DNA, 25 bp, mus musculus
tagagcactacaccgagtgcggact

SEQ ID NO: 120612 - DNA, 25 bp, mus musculus
agcactacaccgagtgcggactggc

SEQ ID NO: 120613 - DNA, 25 bp, mus musculus
gcacggcgctcacaagcagaactac

SEQ ID NO: 120614 - DNA, 25 bp, mus musculus
acggcgctcacaagcagaactacct

SEQ ID NO: 120615 - DNA, 25 bp, mus musculus
ggcgctcacaagcagaactacctcg

SEQ ID NO: 120616 - DNA, 25 bp, mus musculus
cgctcacaagcagaactacctcgcg

SEQ ID NO: 120617 - DNA, 25 bp, mus musculus
ctcacaagcagaactacctcgcgca

SEQ ID NO: 120618 - DNA, 25 bp, mus musculus
tcgcgcacctcatgcgattcgcaag

SEQ ID NO: 120619 - DNA, 25 bp, mus musculus
gcgcacctcatgcgattcgcaagct

SEQ ID NO: 120620 - DNA, 25 bp, mus musculus
acctcatgcgattcgcaagctgctt

SEQ ID NO: 120621 - DNA, 25 bp, mus musculus
tgtgctctgtggcaatggagcaact

SEQ ID NO: 120622 - DNA, 25 bp, mus musculus
ctaccctggactaccattgggatct

SEQ ID NO: 120623 - DNA, 25 bp, mus musculus
gaatgcatacctaccaagtgggcat

SEQ ID NO: 120624 - DNA, 25 bp, mus musculus
atgcatacctaccaagtgggcatga

SEQ ID NO: 120625 - DNA, 25 bp, mus musculus
atacctaccaagtgggcatgaacga

SEQ ID NO: 120626 - DNA, 25 bp, mus musculus
acctaccaagtgggcatgaacgata

SEQ ID NO: 120627 - DNA, 25 bp, mus musculus
tgtgtcggatgggtgctctgagaat

SEQ ID NO: 120628 - DNA, 25 bp, mus musculus
gtgctctgagaattccccgacagtc

SEQ ID NO: 120629 - DNA, 25 bp, mus musculus
gctctgagaattccccgacagtctc

SEQ ID NO: 120630 - DNA, 25 bp, mus musculus
tgagaattccccgacagtctccgaa

SEQ ID NO: 120631 - DNA, 25 bp, mus musculus
ttccccgacagtctccgaagactgt

SEQ ID NO: 120632 - DNA, 25 bp, mus musculus
ccccgacagtctccgaagactgtca

SEQ ID NO: 120633 - DNA, 25 bp, mus musculus
tggactaccattgggatctctggaa

SEQ ID NO: 120634 - DNA, 25 bp, mus musculus
gacagtctccgaagactgtcacttt

SEQ ID NO: 120635 - DNA, 25 bp, mus musculus
ctaccattgggatctctggaagaaa

SEQ ID NO: 120636 - DNA, 25 bp, mus musculus
agaagtacggcgtctcatcgtggga

SEQ ID NO: 120637 - DNA, 25 bp, mus musculus
taatgattcacaatctcgaatattc

SEQ ID NO: 120638 - DNA, 25 bp, mus musculus
atgattcacaatctcgaatattcta

SEQ ID NO: 120639 - DNA, 25 bp, mus musculus
ttcacaatctcgaatattctatggg

SEQ ID NO: 120640 - DNA, 25 bp, mus musculus
cacaatctcgaatattctatgggaa

SEQ ID NO: 120641 - DNA, 25 bp, mus musculus
atctcgaatattctatgggaatgca

SEQ ID NO: 120642 - DNA, 25 bp, mus musculus
atctcaatgtggctcatgaagaaat

SEQ ID NO: 120643 - DNA, 25 bp, mus musculus
ctggctttactccccaggagcgcca

SEQ ID NO: 120644 - DNA, 25 bp, mus musculus
ctcttttacctgcattgtgtgacag

SEQ ID NO: 120645 - DNA, 25 bp, mus musculus
tacctgcattgtgtgacagcaagat

SEQ ID NO: 120646 - DNA, 25 bp, mus musculus
ccaaggctcttggcagtgaccactg

SEQ ID NO: 120647 - DNA, 25 bp, mus musculus
ctcttggcagtgaccactgtcccat

SEQ ID NO: 120648 - DNA, 25 bp, mus musculus
tttacctagcactgtgataccctcc

SEQ ID NO: 120649 - DNA, 25 bp, mus musculus
tgtgataccctcctgcagtagcttc

SEQ ID NO: 120650 - DNA, 25 bp, mus musculus
ctgcagtagcttcctgcctgggaga

SEQ ID NO: 120651 - DNA, 25 bp, mus musculus
atggctctctctgcagaagtctggt

SEQ ID NO: 120652 - DNA, 25 bp, mus musculus
ctctctgcagaagtctggtgtttta

SEQ ID NO: 120653 - DNA, 25 bp, mus musculus
tgtgctccctcattttaaacattaa

SEQ ID NO: 120654 - DNA, 25 bp, mus musculus
tacaagctgtaccattggctgacag

SEQ ID NO: 120655 - DNA, 25 bp, mus musculus
cattggctgacagcttccggcatct

SEQ ID NO: 120656 - DNA, 25 bp, mus musculus
ccaacactgcttacgcttacacttt

SEQ ID NO: 120657 - DNA, 25 bp, mus musculus
ctgcttacgcttacactttctggac

SEQ ID NO: 120658 - DNA, 25 bp, mus musculus
acgcttacactttctggacttacat

SEQ ID NO: 120659 - DNA, 25 bp, mus musculus
acactttctggacttacatgatgaa

SEQ ID NO: 120660 - DNA, 25 bp, mus musculus
atgcccgctctaagaatgttggttg

SEQ ID NO: 120661 - DNA, 25 bp, mus musculus
cccactctcttttacctgcattgtg

SEQ ID NO: 120662 - DNA, 25 bp, mus musculus
tcaaattcggtgcagcccggaatcc

SEQ ID NO: 120663 - DNA, 25 bp, mus musculus
attcggtgcagcccggaatcccgag

SEQ ID NO: 120664 - DNA, 25 bp, mus musculus
aaactggcaatacttctcccagagc

SEQ ID NO: 120665 - DNA, 25 bp, mus musculus
tggcaatacttctcccagagcgatc

SEQ ID NO: 120666 - DNA, 25 bp, mus musculus
aatacttctcccagagcgatctcac

SEQ ID NO: 120667 - DNA, 25 bp, mus musculus
tacttctcccagagcgatctcacgg

SEQ ID NO: 120668 - DNA, 25 bp, mus musculus
tctcccagagcgatctcacgggccg

SEQ ID NO: 120669 - DNA, 25 bp, mus musculus
tcccagagcgatctcacgggccgac

SEQ ID NO: 120670 - DNA, 25 bp, mus musculus
atctcacgggccgaccgagagagga

SEQ ID NO: 120671 - DNA, 25 bp, mus musculus
agcatgagactccacagaggtgccc

SEQ ID NO: 120672 - DNA, 25 bp, mus musculus
catgagactccacagaggtgcccct

SEQ ID NO: 120673 - DNA, 25 bp, mus musculus
tgagactccacagaggtgcccctgc

SEQ ID NO: 120674 - DNA, 25 bp, mus musculus
aagtgcagccgagcctgtggttcca

SEQ ID NO: 120675 - DNA, 25 bp, mus musculus
gtgcagccgagcctgtggttccact

SEQ ID NO: 120676 - DNA, 25 bp, mus musculus
agccgagcctgtggttccactccag

SEQ ID NO: 120677 - DNA, 25 bp, mus musculus
ctcccgcatccaacaaactggcaat

SEQ ID NO: 120678 - DNA, 25 bp, mus musculus
cccgcatccaacaaactggcaatac

SEQ ID NO: 120679 - DNA, 25 bp, mus musculus
cgcatccaacaaactggcaatactt

SEQ ID NO: 120680 - DNA, 25 bp, mus musculus
tccaacaaactggcaatacttctcc

SEQ ID NO: 120681 - DNA, 25 bp, mus musculus
caacaaactggcaatacttctccca

SEQ ID NO: 120682 - DNA, 25 bp, mus musculus
ttcccttctgccgctgctgcttctg

SEQ ID NO: 120683 - DNA, 25 bp, mus musculus
ctccacgttattgcgggacgaagag

SEQ ID NO: 120684 - DNA, 25 bp, mus musculus
acagtcagatcacgcgcctgtacag

SEQ ID NO: 120685 - DNA, 25 bp, mus musculus
cagtcagatcacgcgcctgtacagc

SEQ ID NO: 120686 - DNA, 25 bp, mus musculus
gtcagatcacgcgcctgtacagccg

SEQ ID NO: 120687 - DNA, 25 bp, mus musculus
tcagatcacgcgcctgtacagccgc

SEQ ID NO: 120688 - DNA, 25 bp, mus musculus
agatcacgcgcctgtacagccgctt

SEQ ID NO: 120689 - DNA, 25 bp, mus musculus
acagccgcttcaccagcctggacaa

SEQ ID NO: 120690 - DNA, 25 bp, mus musculus
gccgcttcaccagcctggacaaagg

SEQ ID NO: 120691 - DNA, 25 bp, mus musculus
ggactctcagccgggaagatttcca

SEQ ID NO: 120692 - DNA, 25 bp, mus musculus
gactctcagccgggaagatttccag

SEQ ID NO: 120693 - DNA, 25 bp, mus musculus
ctctcagccgggaagatttccagag

SEQ ID NO: 120694 - DNA, 25 bp, mus musculus
cgttattgcgggacgaagagctcga

SEQ ID NO: 120695 - DNA, 25 bp, mus musculus
agactggcttttcccacagtcagat

SEQ ID NO: 120696 - DNA, 25 bp, mus musculus
gactggcttttcccacagtcagatc

SEQ ID NO: 120697 - DNA, 25 bp, mus musculus
ctggcttttcccacagtcagatcac

SEQ ID NO: 120698 - DNA, 25 bp, mus musculus
tggcttttcccacagtcagatcacg

SEQ ID NO: 120699 - DNA, 25 bp, mus musculus
gcttttcccacagtcagatcacgcg

SEQ ID NO: 120700 - DNA, 25 bp, mus musculus
tttcccacagtcagatcacgcgcct

SEQ ID NO: 120701 - DNA, 25 bp, mus musculus
ccacagtcagatcacgcgcctgtac

SEQ ID NO: 120702 - DNA, 25 bp, mus musculus
aacttctaccccagagacatcaatg

SEQ ID NO: 120703 - DNA, 25 bp, mus musculus
cgagatggcatcctgaccagttata

SEQ ID NO: 120704 - DNA, 25 bp, mus musculus
cacaagacgtcaacttcgcccatcg

SEQ ID NO: 120705 - DNA, 25 bp, mus musculus
acttcgcccatcgtcaagagcttca

SEQ ID NO: 120706 - DNA, 25 bp, mus musculus
agcttcaacaggaatgagtgttaga

SEQ ID NO: 120707 - DNA, 25 bp, mus musculus
agccaaaggtcctgaggtgccacac

SEQ ID NO: 120708 - DNA, 25 bp, mus musculus
cagctccatcctatctatcctccta

SEQ ID NO: 120709 - DNA, 25 bp, mus musculus
ccacaagcaacctaccactgttgca

SEQ ID NO: 120710 - DNA, 25 bp, mus musculus
gcaacctaccactgttgcagtgctc

SEQ ID NO: 120711 - DNA, 25 bp, mus musculus
tgttgcagtgctccaaacctcctcc

SEQ ID NO: 120712 - DNA, 25 bp, mus musculus
tccctttccttggcttttatcatgc

SEQ ID NO: 120713 - DNA, 25 bp, mus musculus
tccttggcttttatcatgctaatat

SEQ ID NO: 120714 - DNA, 25 bp, mus musculus
ggcatcctgaccagttatactgatc

SEQ ID NO: 120715 - DNA, 25 bp, mus musculus
agcaaagacagcacctacagcttga

SEQ ID NO: 120716 - DNA, 25 bp, mus musculus
acctacagcttgagcagcaccctca

SEQ ID NO: 120717 - DNA, 25 bp, mus musculus
agcttgagcagcaccctcacattga

SEQ ID NO: 120718 - DNA, 25 bp, mus musculus
cgacataacagctatacctgtgagg

SEQ ID NO: 120719 - DNA, 25 bp, mus musculus
tatacctgtgaggccactcacaaga

SEQ ID NO: 120720 - DNA, 25 bp, mus musculus
tgtgaggccactcacaagacgtcaa

SEQ ID NO: 120721 - DNA, 25 bp, mus musculus
gccactcacaagacgtcaacttcgc

SEQ ID NO: 120722 - DNA, 25 bp, mus musculus
cgagatggcatcctgaccagttata

SEQ ID NO: 120723 - DNA, 25 bp, mus musculus
ggcatcctgaccagttatactgatc

SEQ ID NO: 120724 - DNA, 25 bp, mus musculus
gcatcctgaccagttatactgatca

SEQ ID NO: 120725 - DNA, 25 bp, mus musculus
catcctgaccagttatactgatcag

SEQ ID NO: 120726 - DNA, 25 bp, mus musculus
agacgtcaacttcgcccatcgtcaa

SEQ ID NO: 120727 - DNA, 25 bp, mus musculus
agccaaaggtcctgaggtgccacac

SEQ ID NO: 120728 - DNA, 25 bp, mus musculus
atctatcctcctaaggtcttggaga

SEQ ID NO: 120729 - DNA, 25 bp, mus musculus
tctatcctcctaaggtcttggagac

SEQ ID NO: 120730 - DNA, 25 bp, mus musculus
ctatcctcctaaggtcttggagact

SEQ ID NO: 120731 - DNA, 25 bp, mus musculus
tatcctcctaaggtcttggagactt

SEQ ID NO: 120732 - DNA, 25 bp, mus musculus
cgagatggcatcctgaccagttata

SEQ ID NO: 120733 - DNA, 25 bp, mus musculus
ggcatcctgaccagttatactgatc

SEQ ID NO: 120734 - DNA, 25 bp, mus musculus
gaggtgccacaccaccagctcccca

SEQ ID NO: 120735 - DNA, 25 bp, mus musculus
atctatcctcctaaggtcttggaga

SEQ ID NO: 120736 - DNA, 25 bp, mus musculus
tctatcctcctaaggtcttggagac

SEQ ID NO: 120737 - DNA, 25 bp, mus musculus
ctatcctcctaaggtcttggagact

SEQ ID NO: 120738 - DNA, 25 bp, mus musculus
tatcctcctaaggtcttggagactt

SEQ ID NO: 120739 - DNA, 25 bp, mus musculus
gcatcctgaccagttatactgatca

SEQ ID NO: 120740 - DNA, 25 bp, mus musculus
catcctgaccagttatactgatcag

SEQ ID NO: 120741 - DNA, 25 bp, mus musculus
atcctgaccagttatactgatcagg

SEQ ID NO: 120742 - DNA, 25 bp, mus musculus
agacgtcaacttcgcccatcgtcaa

SEQ ID NO: 120743 - DNA, 25 bp, mus musculus
agccaaaggtcctgaggtgccacac

SEQ ID NO: 120744 - DNA, 25 bp, mus musculus
cctgaggtgccacaccaccagctcc

SEQ ID NO: 120745 - DNA, 25 bp, mus musculus
ctgaggtgccacaccaccagctccc

SEQ ID NO: 120746 - DNA, 25 bp, mus musculus
tgaggtgccacaccaccagctcccc

SEQ ID NO: 120747 - DNA, 25 bp, mus musculus
ccatgccagcctgtagcacctgagg

SEQ ID NO: 120748 - DNA, 25 bp, mus musculus
taccaatcttttgtgcgtattttca

SEQ ID NO: 120749 - DNA, 25 bp, mus musculus
ctctgcttctgtgaccactgtcaat

SEQ ID NO: 120750 - DNA, 25 bp, mus musculus
ctgcttctgtgaccactgtcaatct

SEQ ID NO: 120751 - DNA, 25 bp, mus musculus
gcttctgtgaccactgtcaatctct

SEQ ID NO: 120752 - DNA, 25 bp, mus musculus
ttctgtgaccactgtcaatctcttg

SEQ ID NO: 120753 - DNA, 25 bp, mus musculus
gtgaccactgtcaatctcttgtcgt

SEQ ID NO: 120754 - DNA, 25 bp, mus musculus
ccactgtcaatctcttgtcgtactt

SEQ ID NO: 120755 - DNA, 25 bp, mus musculus
actgtcaatctcttgtcgtacttag

SEQ ID NO: 120756 - DNA, 25 bp, mus musculus
tcaatctcttgtcgtacttagtagt

SEQ ID NO: 120757 - DNA, 25 bp, mus musculus
aatctcttgtcgtacttagtagtga

SEQ ID NO: 120758 - DNA, 25 bp, mus musculus
tctcttgtcgtacttagtagtgaaa

SEQ ID NO: 120759 - DNA, 25 bp, mus musculus
ttcctaagcattttcattccgtcct

SEQ ID NO: 120760 - DNA, 25 bp, mus musculus
taagcattttcattccgtccttctt

SEQ ID NO: 120761 - DNA, 25 bp, mus musculus
gctcatttgacctggctgtgtatct

SEQ ID NO: 120762 - DNA, 25 bp, mus musculus
tcatttgacctggctgtgtatctgc

SEQ ID NO: 120763 - DNA, 25 bp, mus musculus
ttgacctggctgtgtatctgctctg

SEQ ID NO: 120764 - DNA, 25 bp, mus musculus
gacctggctgtgtatctgctctgct

SEQ ID NO: 120765 - DNA, 25 bp, mus musculus
tgtatctgctctgcttctgtgacca

SEQ ID NO: 120766 - DNA, 25 bp, mus musculus
tctgctctgcttctgtgaccactgt

SEQ ID NO: 120767 - DNA, 25 bp, mus musculus
ccaagcccaagtccatcttcaggaa

SEQ ID NO: 120768 - DNA, 25 bp, mus musculus
ccggtcaccatccatgcctggacag

SEQ ID NO: 120769 - DNA, 25 bp, mus musculus
catcttgcaagctcagggactggct

SEQ ID NO: 120770 - DNA, 25 bp, mus musculus
gcaagctcagggactggctgcgttg

SEQ ID NO: 120771 - DNA, 25 bp, mus musculus
actggctgcgttggacctaggaggt

SEQ ID NO: 120772 - DNA, 25 bp, mus musculus
tgcgttggacctaggaggttcctca

SEQ ID NO: 120773 - DNA, 25 bp, mus musculus
aggaggttcctcagatccctatgtt

SEQ ID NO: 120774 - DNA, 25 bp, mus musculus
aggttcctcagatccctatgttagt

SEQ ID NO: 120775 - DNA, 25 bp, mus musculus
agatccctatgttagtgtctatctg

SEQ ID NO: 120776 - DNA, 25 bp, mus musculus
tagtgtctatctgctgccagacaag

SEQ ID NO: 120777 - DNA, 25 bp, mus musculus
tgtctatctgctgccagacaagcgg

SEQ ID NO: 120778 - DNA, 25 bp, mus musculus
ctatctgctgccagacaagcggagg

SEQ ID NO: 120779 - DNA, 25 bp, mus musculus
gtcaccatccatgcctggacagcag

SEQ ID NO: 120780 - DNA, 25 bp, mus musculus
agacaaacaccagctaggccgactg

SEQ ID NO: 120781 - DNA, 25 bp, mus musculus
gctaggccgactgcagtattcactg

SEQ ID NO: 120782 - DNA, 25 bp, mus musculus
aggccgactgcagtattcactggac

SEQ ID NO: 120783 - DNA, 25 bp, mus musculus
ccgactgcagtattcactggactat

SEQ ID NO: 120784 - DNA, 25 bp, mus musculus
tgacttccagactggccagctcctg

SEQ ID NO: 120785 - DNA, 25 bp, mus musculus
ccagactggccagctcctggtgggc

SEQ ID NO: 120786 - DNA, 25 bp, mus musculus
cctggtgggcatcttgcaagctcag

SEQ ID NO: 120787 - DNA, 25 bp, mus musculus
gaagccgcaggacgaagctgttctc

SEQ ID NO: 120788 - DNA, 25 bp, mus musculus
cgaagctgttctcaccgctactctg

SEQ ID NO: 120789 - DNA, 25 bp, mus musculus
gagtgccgtactccaagaggctcgg

SEQ ID NO: 120790 - DNA, 25 bp, mus musculus
tgccgtactccaagaggctcgggtc

SEQ ID NO: 120791 - DNA, 25 bp, mus musculus
tcccatcaatccccggaaatgtgct

SEQ ID NO: 120792 - DNA, 25 bp, mus musculus
catcaatccccggaaatgtgctcac

SEQ ID NO: 120793 - DNA, 25 bp, mus musculus
tccccggaaatgtgctcacatcctc

SEQ ID NO: 120794 - DNA, 25 bp, mus musculus
gaaatgtgctcacatcctcaccaag

SEQ ID NO: 120795 - DNA, 25 bp, mus musculus
catcctcaccaagatcctttatctc

SEQ ID NO: 120796 - DNA, 25 bp, mus musculus
caccaagatcctttatctcataaac

SEQ ID NO: 120797 - DNA, 25 bp, mus musculus
caagatcctttatctcataaaccag

SEQ ID NO: 120798 - DNA, 25 bp, mus musculus
gatcctttatctcataaaccagggg

SEQ ID NO: 120799 - DNA, 25 bp, mus musculus
agctgttctcaccgctactctgagc

SEQ ID NO: 120800 - DNA, 25 bp, mus musculus
tgttctcaccgctactctgagcatc

SEQ ID NO: 120801 - DNA, 25 bp, mus musculus
caccgctactctgagcatcttcctg

SEQ ID NO: 120802 - DNA, 25 bp, mus musculus
gagcatcttcctgctgcgtggagct

SEQ ID NO: 120803 - DNA, 25 bp, mus musculus
cttcctgctgcgtggagctaccgct

SEQ ID NO: 120804 - DNA, 25 bp, mus musculus
taccgctgacaccatgttgaagaaa

SEQ ID NO: 120805 - DNA, 25 bp, mus musculus
cgctgacaccatgttgaagaaattc

SEQ ID NO: 120806 - DNA, 25 bp, mus musculus
cctccagcacctggagaagagtgcc

SEQ ID NO: 120807 - DNA, 25 bp, mus musculus
aaggtgtcctgtccaatatctcgtc

SEQ ID NO: 120808 - DNA, 25 bp, mus musculus
gtgtcctgtccaatatctcgtccat

SEQ ID NO: 120809 - DNA, 25 bp, mus musculus
tgcatcggagcactgcgggaaaaca

SEQ ID NO: 120810 - DNA, 25 bp, mus musculus
attattttcttcctggaactcactg

SEQ ID NO: 120811 - DNA, 25 bp, mus musculus
attttcttcctggaactcactgctg

SEQ ID NO: 120812 - DNA, 25 bp, mus musculus
gaactcactgctggggtgttggcat

SEQ ID NO: 120813 - DNA, 25 bp, mus musculus
atcaaagaccagctgtatttcttta

SEQ ID NO: 120814 - DNA, 25 bp, mus musculus
tatttctttattaacaacaacatca

SEQ ID NO: 120815 - DNA, 25 bp, mus musculus
ttctttattaacaacaacatcagag

SEQ ID NO: 120816 - DNA, 25 bp, mus musculus
tttattaacaacaacatcagagcct

SEQ ID NO: 120817 - DNA, 25 bp, mus musculus
attaacaacaacatcagagcctaca

SEQ ID NO: 120818 - DNA, 25 bp, mus musculus
atcagagcctacagagatgacattg

SEQ ID NO: 120819 - DNA, 25 bp, mus musculus
tgtccaatatctcgtccatcaccga

SEQ ID NO: 120820 - DNA, 25 bp, mus musculus
ccgacctcaggtggctttgacccag

SEQ ID NO: 120821 - DNA, 25 bp, mus musculus
acctcaggtggctttgacccagtct

SEQ ID NO: 120822 - DNA, 25 bp, mus musculus
ggtggctttgacccagtctggcttt

SEQ ID NO: 120823 - DNA, 25 bp, mus musculus
tttgacccagtctggcttttcctcg

SEQ ID NO: 120824 - DNA, 25 bp, mus musculus
gtgatgttcattctggggtttgcag

SEQ ID NO: 120825 - DNA, 25 bp, mus musculus
atgttcattctggggtttgcagggt

SEQ ID NO: 120826 - DNA, 25 bp, mus musculus
tttgcagggtgcatcggagcactgc

SEQ ID NO: 120827 - DNA, 25 bp, mus musculus
aatgagcaggccatcatagacgtgc

SEQ ID NO: 120828 - DNA, 25 bp, mus musculus
tgagcaggccatcatagacgtgctc

SEQ ID NO: 120829 - DNA, 25 bp, mus musculus
ctacgaggccaaggagctgcacgat

SEQ ID NO: 120830 - DNA, 25 bp, mus musculus
ctgcacgatgccatgaagggcttag

SEQ ID NO: 120831 - DNA, 25 bp, mus musculus
agtcatcattgagatcctagcttct

SEQ ID NO: 120832 - DNA, 25 bp, mus musculus
atcattgagatcctagcttctcgga

SEQ ID NO: 120833 - DNA, 25 bp, mus musculus
cattgagatcctagcttctcggacc

SEQ ID NO: 120834 - DNA, 25 bp, mus musculus
gatcctagcttctcggaccaagaac

SEQ ID NO: 120835 - DNA, 25 bp, mus musculus
agcttctcggaccaagaaccagctg

SEQ ID NO: 120836 - DNA, 25 bp, mus musculus
tctcggaccaagaaccagctgagag

SEQ ID NO: 120837 - DNA, 25 bp, mus musculus
tcggaccaagaaccagctgagagag

SEQ ID NO: 120838 - DNA, 25 bp, mus musculus
accaagaaccagctgagagagataa

SEQ ID NO: 120839 - DNA, 25 bp, mus musculus
caggccatcatagacgtgctcacca

SEQ ID NO: 120840 - DNA, 25 bp, mus musculus
gacctcactgagaccttaaagtcag

SEQ ID NO: 120841 - DNA, 25 bp, mus musculus
cctcactgagaccttaaagtcagag

SEQ ID NO: 120842 - DNA, 25 bp, mus musculus
atttgagagactcatcgtggccctc

SEQ ID NO: 120843 - DNA, 25 bp, mus musculus
gagagactcatcgtggccctcatgt

SEQ ID NO: 120844 - DNA, 25 bp, mus musculus
ccatacagctacgaggccaaggagc

SEQ ID NO: 120845 - DNA, 25 bp, mus musculus
atacagctacgaggccaaggagctg

SEQ ID NO: 120846 - DNA, 25 bp, mus musculus
agctacgaggccaaggagctgcacg

SEQ ID NO: 120847 - DNA, 25 bp, mus musculus
tatgactgtaacccctggtccagca

SEQ ID NO: 120848 - DNA, 25 bp, mus musculus
gactgtaacccctggtccagcaaat

SEQ ID NO: 120849 - DNA, 25 bp, mus musculus
ctcatctacttgaagtggtccgccc

SEQ ID NO: 120850 - DNA, 25 bp, mus musculus
ttgaagtggtccgcccttgttgcac

SEQ ID NO: 120851 - DNA, 25 bp, mus musculus
cttgttgcactgatgagctaacctg

SEQ ID NO: 120852 - DNA, 25 bp, mus musculus
ctgatgagctaacctgtagggacac

SEQ ID NO: 120853 - DNA, 25 bp, mus musculus
agctaacctgtagggacactatgtc

SEQ ID NO: 120854 - DNA, 25 bp, mus musculus
tatcttaatcctactcagtgaagat

SEQ ID NO: 120855 - DNA, 25 bp, mus musculus
cttaatcctactcagtgaagatgtt

SEQ ID NO: 120856 - DNA, 25 bp, mus musculus
aatcctactcagtgaagatgttcac

SEQ ID NO: 120857 - DNA, 25 bp, mus musculus
tgttcacgtaattcggctagttctg

SEQ ID NO: 120858 - DNA, 25 bp, mus musculus
cgtaattcggctagttctgttgaat

SEQ ID NO: 120859 - DNA, 25 bp, mus musculus
ccctggtccagcaaatacgccaatg

SEQ ID NO: 120860 - DNA, 25 bp, mus musculus
tggtccagcaaatacgccaatgatg

SEQ ID NO: 120861 - DNA, 25 bp, mus musculus
tacgccaatgatgtctctcacatgc

SEQ ID NO: 120862 - DNA, 25 bp, mus musculus
aatgatgtctctcacatgcactgtg

SEQ ID NO: 120863 - DNA, 25 bp, mus musculus
gtctctcacatgcactgtgtcctca

SEQ ID NO: 120864 - DNA, 25 bp, mus musculus
cacatgcactgtgtcctcatctact

SEQ ID NO: 120865 - DNA, 25 bp, mus musculus
atgcactgtgtcctcatctacttga

SEQ ID NO: 120866 - DNA, 25 bp, mus musculus
gtcctcatctacttgaagtggtccg

SEQ ID NO: 120867 - DNA, 25 bp, mus musculus
ttgactcctgtttgcagatgacttt

SEQ ID NO: 120868 - DNA, 25 bp, mus musculus
actcctgtttgcagatgactttgag

SEQ ID NO: 120869 - DNA, 25 bp, mus musculus
tgaatatggcccagatataggccca

SEQ ID NO: 120870 - DNA, 25 bp, mus musculus
atatggcccagatataggcccacct

SEQ ID NO: 120871 - DNA, 25 bp, mus musculus
agatataggcccaccttatcagagt

SEQ ID NO: 120872 - DNA, 25 bp, mus musculus
tataggcccaccttatcagagtctc

SEQ ID NO: 120873 - DNA, 25 bp, mus musculus
tcagagtctcccctatgggccagat

SEQ ID NO: 120874 - DNA, 25 bp, mus musculus
tctcccctatgggccagatctgtat

SEQ ID NO: 120875 - DNA, 25 bp, mus musculus
cccctatgggccagatctgtatcca

SEQ ID NO: 120876 - DNA, 25 bp, mus musculus
cgccttcgacatgccggactttgag

SEQ ID NO: 120877 - DNA, 25 bp, mus musculus
cgacatgccggactttgaggatgat

SEQ ID NO: 120878 - DNA, 25 bp, mus musculus
catgccggactttgaggatgatggt

SEQ ID NO: 120879 - DNA, 25 bp, mus musculus
cctgtttgcagatgactttgaggcc

SEQ ID NO: 120880 - DNA, 25 bp, mus musculus
tgactttgaggccctttgcaatgtg

SEQ ID NO: 120881 - DNA, 25 bp, mus musculus
tgaggccctttgcaatgtgctgcgt

SEQ ID NO: 120882 - DNA, 25 bp, mus musculus
ggccctttgcaatgtgctgcgtcca

SEQ ID NO: 120883 - DNA, 25 bp, mus musculus
cctttgcaatgtgctgcgtccacct

SEQ ID NO: 120884 - DNA, 25 bp, mus musculus
caatgtgctgcgtccacctgcctat

SEQ ID NO: 120885 - DNA, 25 bp, mus musculus
tgtgctgcgtccacctgcctatggc

SEQ ID NO: 120886 - DNA, 25 bp, mus musculus
tccctatgaatatggcccagatata

SEQ ID NO: 120887 - DNA, 25 bp, mus musculus
catcttgacaactatgctggctacg

SEQ ID NO: 120888 - DNA, 25 bp, mus musculus
tcttgacaactatgctggctacgag

SEQ ID NO: 120889 - DNA, 25 bp, mus musculus
ggcttacacaaaaatctgtgatcca

SEQ ID NO: 120890 - DNA, 25 bp, mus musculus
cttacacaaaaatctgtgatccagg

SEQ ID NO: 120891 - DNA, 25 bp, mus musculus
aatctgtgatccaggcctcactgcc

SEQ ID NO: 120892 - DNA, 25 bp, mus musculus
tctgtgatccaggcctcactgcctt

SEQ ID NO: 120893 - DNA, 25 bp, mus musculus
tgatccaggcctcactgcctttgaa

SEQ ID NO: 120894 - DNA, 25 bp, mus musculus
ccaggcctcactgcctttgaacctg

SEQ ID NO: 120895 - DNA, 25 bp, mus musculus
aggcctcactgcctttgaacctgaa

SEQ ID NO: 120896 - DNA, 25 bp, mus musculus
cactgcctttgaacctgaagcattg

SEQ ID NO: 120897 - DNA, 25 bp, mus musculus
gcctttgaacctgaagcattgggca

SEQ ID NO: 120898 - DNA, 25 bp, mus musculus
agcattgggcaacttagtggaaggg

SEQ ID NO: 120899 - DNA, 25 bp, mus musculus
ttgacaactatgctggctacgagaa

SEQ ID NO: 120900 - DNA, 25 bp, mus musculus
gaaatttttcagcagccaagagttt

SEQ ID NO: 120901 - DNA, 25 bp, mus musculus
caccaccattgaggatgaagacgtg

SEQ ID NO: 120902 - DNA, 25 bp, mus musculus
tcatcaaagtcactgagcaactgat

SEQ ID NO: 120903 - DNA, 25 bp, mus musculus
atcaaagtcactgagcaactgattg

SEQ ID NO: 120904 - DNA, 25 bp, mus musculus
caaagtcactgagcaactgattgaa

SEQ ID NO: 120905 - DNA, 25 bp, mus musculus
aagtcactgagcaactgattgaagc

SEQ ID NO: 120906 - DNA, 25 bp, mus musculus
gaggcttacacaaaaatctgtgatc

SEQ ID NO: 120907 - DNA, 25 bp, mus musculus
gtacatttttgctcaactgcttgtg

SEQ ID NO: 120908 - DNA, 25 bp, mus musculus
catttttgctcaactgcttgtgagt

SEQ ID NO: 120909 - DNA, 25 bp, mus musculus
tactgtacaagctgagcaaacagac

SEQ ID NO: 120910 - DNA, 25 bp, mus musculus
gcaaacagactgacctcatgtcaga

SEQ ID NO: 120911 - DNA, 25 bp, mus musculus
aacagactgacctcatgtcagattt

SEQ ID NO: 120912 - DNA, 25 bp, mus musculus
agactgacctcatgtcagatttgtg

SEQ ID NO: 120913 - DNA, 25 bp, mus musculus
ctgacctcatgtcagatttgtggga

SEQ ID NO: 120914 - DNA, 25 bp, mus musculus
acctcatgtcagatttgtgggaaaa

SEQ ID NO: 120915 - DNA, 25 bp, mus musculus
tttctctgaccttggcctatctaac

SEQ ID NO: 120916 - DNA, 25 bp, mus musculus
tgaccttggcctatctaactggatc

SEQ ID NO: 120917 - DNA, 25 bp, mus musculus
ccttggcctatctaactggatcagc

SEQ ID NO: 120918 - DNA, 25 bp, mus musculus
tggcctatctaactggatcagcctc

SEQ ID NO: 120919 - DNA, 25 bp, mus musculus
tgctcaactgcttgtgagttttggt

SEQ ID NO: 120920 - DNA, 25 bp, mus musculus
tcaactgcttgtgagttttggtccc

SEQ ID NO: 120921 - DNA, 25 bp, mus musculus
tggtcccattgtgtcctttgtatga

SEQ ID NO: 120922 - DNA, 25 bp, mus musculus
tcccattgtgtcctttgtatgaagt

SEQ ID NO: 120923 - DNA, 25 bp, mus musculus
cattgtgtcctttgtatgaagtttg

SEQ ID NO: 120924 - DNA, 25 bp, mus musculus
tgtgtcctttgtatgaagtttgtgg

SEQ ID NO: 120925 - DNA, 25 bp, mus musculus
aaatctagctactgtacaagctgag

SEQ ID NO: 120926 - DNA, 25 bp, mus musculus
agctactgtacaagctgagcaaaca

SEQ ID NO: 120927 - DNA, 25 bp, mus musculus
ccttctcagaagtgatcctggcaga

SEQ ID NO: 120928 - DNA, 25 bp, mus musculus
tgatcctggcagaggacaagaggac

SEQ ID NO: 120929 - DNA, 25 bp, mus musculus
accccaacattgtagccctggatga

SEQ ID NO: 120930 - DNA, 25 bp, mus musculus
ccaacattgtagccctggatgacat

SEQ ID NO: 120931 - DNA, 25 bp, mus musculus
ttgtagccctggatgacatctatga

SEQ ID NO: 120932 - DNA, 25 bp, mus musculus
tagccctggatgacatctatgagag

SEQ ID NO: 120933 - DNA, 25 bp, mus musculus
acctctacctcatcatgcagctggt

SEQ ID NO: 120934 - DNA, 25 bp, mus musculus
tctacctcatcatgcagctggtttc

SEQ ID NO: 120935 - DNA, 25 bp, mus musculus
acctcatcatgcagctggtttcagg

SEQ ID NO: 120936 - DNA, 25 bp, mus musculus
tcatgcagctggtttcaggtggaga

SEQ ID NO: 120937 - DNA, 25 bp, mus musculus
tgcagctggtttcaggtggagagct

SEQ ID NO: 120938 - DNA, 25 bp, mus musculus
agctggtttcaggtggagagctgtt

SEQ ID NO: 120939 - DNA, 25 bp, mus musculus
tggccatcaaatgcattgccaagaa

SEQ ID NO: 120940 - DNA, 25 bp, mus musculus
gcattgccaagaaagccctggaggc

SEQ ID NO: 120941 - DNA, 25 bp, mus musculus
agattgccgtcttacacaagatcaa

SEQ ID NO: 120942 - DNA, 25 bp, mus musculus
ttgccgtcttacacaagatcaagca

SEQ ID NO: 120943 - DNA, 25 bp, mus musculus
ccgtcttacacaagatcaagcaccc

SEQ ID NO: 120944 - DNA, 25 bp, mus musculus
tacacaagatcaagcaccccaacat

SEQ ID NO: 120945 - DNA, 25 bp, mus musculus
acaagatcaagcaccccaacattgt

SEQ ID NO: 120946 - DNA, 25 bp, mus musculus
agcaccccaacattgtagccctgga

SEQ ID NO: 120947 - DNA, 25 bp, mus musculus
acatacggtcagtgtgtagatgtct

SEQ ID NO: 120948 - DNA, 25 bp, mus musculus
tgtagatgtctgcgggctctgggtc

SEQ ID NO: 120949 - DNA, 25 bp, mus musculus
caatcagaggtgctcgtgtcctgtg

SEQ ID NO: 120950 - DNA, 25 bp, mus musculus
atcagaggtgctcgtgtcctgtgga

SEQ ID NO: 120951 - DNA, 25 bp, mus musculus
cagaggtgctcgtgtcctgtggaac

SEQ ID NO: 120952 - DNA, 25 bp, mus musculus
ggtgctcgtgtcctgtggaacctaa

SEQ ID NO: 120953 - DNA, 25 bp, mus musculus
tgctcgtgtcctgtggaacctaaac

SEQ ID NO: 120954 - DNA, 25 bp, mus musculus
ctcgtgtcctgtggaacctaaacag

SEQ ID NO: 120955 - DNA, 25 bp, mus musculus
tcctgtggaacctaaacaggaagag

SEQ ID NO: 120956 - DNA, 25 bp, mus musculus
aagagctcaattccaagatgatgga

SEQ ID NO: 120957 - DNA, 25 bp, mus musculus
gagctcaattccaagatgatggatt

SEQ ID NO: 120958 - DNA, 25 bp, mus musculus
gctcaattccaagatgatggatttt

SEQ ID NO: 120959 - DNA, 25 bp, mus musculus
gatgtctgcgggctctgggtcagaa

SEQ ID NO: 120960 - DNA, 25 bp, mus musculus
gggtcagaatcctacgcaatcagag

SEQ ID NO: 120961 - DNA, 25 bp, mus musculus
gtcagaatcctacgcaatcagaggt

SEQ ID NO: 120962 - DNA, 25 bp, mus musculus
cagaatcctacgcaatcagaggtgc

SEQ ID NO: 120963 - DNA, 25 bp, mus musculus
gaatcctacgcaatcagaggtgctc

SEQ ID NO: 120964 - DNA, 25 bp, mus musculus
atcctacgcaatcagaggtgctcgt

SEQ ID NO: 120965 - DNA, 25 bp, mus musculus
tacgcaatcagaggtgctcgtgtcc

SEQ ID NO: 120966 - DNA, 25 bp, mus musculus
cgcaatcagaggtgctcgtgtcctg

SEQ ID NO: 120967 - DNA, 25 bp, mus musculus
tttttctatgactatgccactgtgc

SEQ ID NO: 120968 - DNA, 25 bp, mus musculus
ttctatgactatgccactgtgcaga

SEQ ID NO: 120969 - DNA, 25 bp, mus musculus
atcatcatcatcctgagcaagaagg

SEQ ID NO: 120970 - DNA, 25 bp, mus musculus
atcatcatcctgagcaagaaggtga

SEQ ID NO: 120971 - DNA, 25 bp, mus musculus
atcatcctgagcaagaaggtgaagt

SEQ ID NO: 120972 - DNA, 25 bp, mus musculus
aaggcggattccaggtctgagagcc

SEQ ID NO: 120973 - DNA, 25 bp, mus musculus
tccaggtctgagagcccaacatgca

SEQ ID NO: 120974 - DNA, 25 bp, mus musculus
aggtctgagagcccaacatgcaaat

SEQ ID NO: 120975 - DNA, 25 bp, mus musculus
gagagcccaacatgcaaatcctgta

SEQ ID NO: 120976 - DNA, 25 bp, mus musculus
ccaacatgcaaatcctgtaagtcgg

SEQ ID NO: 120977 - DNA, 25 bp, mus musculus
acatgcaaatcctgtaagtcggaac

SEQ ID NO: 120978 - DNA, 25 bp, mus musculus
tgcaaatcctgtaagtcggaactgc

SEQ ID NO: 120979 - DNA, 25 bp, mus musculus
gactatgccactgtgcagactgtgg

SEQ ID NO: 120980 - DNA, 25 bp, mus musculus
tatgccactgtgcagactgtgggga

SEQ ID NO: 120981 - DNA, 25 bp, mus musculus
gccactgtgcagactgtggggatga

SEQ ID NO: 120982 - DNA, 25 bp, mus musculus
actgtgcagactgtggggatgaccc

SEQ ID NO: 120983 - DNA, 25 bp, mus musculus
gggatgaccctggccactatcatgt

SEQ ID NO: 120984 - DNA, 25 bp, mus musculus
accctggccactatcatgttcgtgc

SEQ ID NO: 120985 - DNA, 25 bp, mus musculus
gccactatcatgttcgtgctgggga

SEQ ID NO: 120986 - DNA, 25 bp, mus musculus
ttcgtgctggggatcatcatcatcc

SEQ ID NO: 120987 - DNA, 25 bp, mus musculus
ggttctacagcaagccttggagaag

SEQ ID NO: 120988 - DNA, 25 bp, mus musculus
tctacagcaagccttggagaagttt

SEQ ID NO: 120989 - DNA, 25 bp, mus musculus
gccccatcagtgtggaacaatccag

SEQ ID NO: 120990 - DNA, 25 bp, mus musculus
aatccagcttgacttccagctgcca

SEQ ID NO: 120991 - DNA, 25 bp, mus musculus
cttccagctgccactgagatttgac

SEQ ID NO: 120992 - DNA, 25 bp, mus musculus
ccagctgccactgagatttgaccta

SEQ ID NO: 120993 - DNA, 25 bp, mus musculus
gccggcagtaccccagagtgtccag

SEQ ID NO: 120994 - DNA, 25 bp, mus musculus
ggcagtaccccagagtgtccagtcc

SEQ ID NO: 120995 - DNA, 25 bp, mus musculus
gagtgtccagtccttattcatcgag

SEQ ID NO: 120996 - DNA, 25 bp, mus musculus
ccagtccttattcatcgagcagtgc

SEQ ID NO: 120997 - DNA, 25 bp, mus musculus
gtccttattcatcgagcagtgcttg

SEQ ID NO: 120998 - DNA, 25 bp, mus musculus
catcgagcagtgcttggttctgtgg

SEQ ID NO: 120999 - DNA, 25 bp, mus musculus
ttgggacctcaaccctggagatggg

SEQ ID NO: 121000 - DNA, 25 bp, mus musculus
ggacctcaaccctggagatggggct

SEQ ID NO: 121001 - DNA, 25 bp, mus musculus
caaccctggagatggggctttctat

SEQ ID NO: 121002 - DNA, 25 bp, mus musculus
ggctttctatgggcctaagattgat

SEQ ID NO: 121003 - DNA, 25 bp, mus musculus
tttctatgggcctaagattgatgtg

SEQ ID NO: 121004 - DNA, 25 bp, mus musculus
cgcccttggtcggccccatcagtgt

SEQ ID NO: 121005 - DNA, 25 bp, mus musculus
tggtcggccccatcagtgtggaaca

SEQ ID NO: 121006 - DNA, 25 bp, mus musculus
tcggccccatcagtgtggaacaatc

SEQ ID NO: 121007 - DNA, 25 bp, mus musculus
tgattactaggcacatcccaggcgg

SEQ ID NO: 121008 - DNA, 25 bp, mus musculus
gattactaggcacatcccaggcgga

SEQ ID NO: 121009 - DNA, 25 bp, mus musculus
ctacactctgggtgtgaagccagct

SEQ ID NO: 121010 - DNA, 25 bp, mus musculus
tacactctgggtgtgaagccagctc

SEQ ID NO: 121011 - DNA, 25 bp, mus musculus
acactctgggtgtgaagccagctca

SEQ ID NO: 121012 - DNA, 25 bp, mus musculus
cactctgggtgtgaagccagctcat

SEQ ID NO: 121013 - DNA, 25 bp, mus musculus
tgaagccagctcattgtgggtgtga

SEQ ID NO: 121014 - DNA, 25 bp, mus musculus
gaagccagctcattgtgggtgtgaa

SEQ ID NO: 121015 - DNA, 25 bp, mus musculus
aagccagctcattgtgggtgtgaac

SEQ ID NO: 121016 - DNA, 25 bp, mus musculus
attactaggcacatcccaggcggac

SEQ ID NO: 121017 - DNA, 25 bp, mus musculus
aggcggactgcgcagtgctgatcgt

SEQ ID NO: 121018 - DNA, 25 bp, mus musculus
gcggactgcgcagtgctgatcgtag

SEQ ID NO: 121019 - DNA, 25 bp, mus musculus
cggactgcgcagtgctgatcgtagc

SEQ ID NO: 121020 - DNA, 25 bp, mus musculus
ggactgcgcagtgctgatcgtagca

SEQ ID NO: 121021 - DNA, 25 bp, mus musculus
cgcagtgctgatcgtagcagccgtt

SEQ ID NO: 121022 - DNA, 25 bp, mus musculus
gctgatcgtagcagccgttgtgggc

SEQ ID NO: 121023 - DNA, 25 bp, mus musculus
cctacactctgggtgtgaagccagc

SEQ ID NO: 121024 - DNA, 25 bp, mus musculus
tagctctttgagccttggttggtcg

SEQ ID NO: 121025 - DNA, 25 bp, mus musculus
attacagcaatacactgggctagtg

SEQ ID NO: 121026 - DNA, 25 bp, mus musculus
gaaacactgtactgtacatactatg

SEQ ID NO: 121027 - DNA, 25 bp, mus musculus
tgtacatactatgcttaaaacattt

SEQ ID NO: 121028 - DNA, 25 bp, mus musculus
ccacataatttctgtacatcccaaa

SEQ ID NO: 121029 - DNA, 25 bp, mus musculus
aatttctgtacatcccaaaggatga

SEQ ID NO: 121030 - DNA, 25 bp, mus musculus
tgtacatcccaaaggatgagaagtg

SEQ ID NO: 121031 - DNA, 25 bp, mus musculus
tcgctccgtgtaattaatgaaacta

SEQ ID NO: 121032 - DNA, 25 bp, mus musculus
ttatccaaattcattcatgaatctt

SEQ ID NO: 121033 - DNA, 25 bp, mus musculus
aaattcattcatgaatctttcatat

SEQ ID NO: 121034 - DNA, 25 bp, mus musculus
taacattttagtccaatgtgactag

SEQ ID NO: 121035 - DNA, 25 bp, mus musculus
cattttagtccaatgtgactagtca

SEQ ID NO: 121036 - DNA, 25 bp, mus musculus
cactgggctagtgtctcacaaataa

SEQ ID NO: 121037 - DNA, 25 bp, mus musculus
gtctcacaaataactgatttactca

SEQ ID NO: 121038 - DNA, 25 bp, mus musculus
actgatttactcagagccacctgac

SEQ ID NO: 121039 - DNA, 25 bp, mus musculus
gatttactcagagccacctgacagc

SEQ ID NO: 121040 - DNA, 25 bp, mus musculus
ttactcagagccacctgacagcagg

SEQ ID NO: 121041 - DNA, 25 bp, mus musculus
acctgacagcaggccactagtgaca

SEQ ID NO: 121042 - DNA, 25 bp, mus musculus
cagcaggccactagtgacagtttct

SEQ ID NO: 121043 - DNA, 25 bp, mus musculus
gccactagtgacagtttctgttatg

SEQ ID NO: 121044 - DNA, 25 bp, mus musculus
accgctgaatctgacccagtggctg

SEQ ID NO: 121045 - DNA, 25 bp, mus musculus
cgctgaatctgacccagtggctgat

SEQ ID NO: 121046 - DNA, 25 bp, mus musculus
tgtgatcctcatggatgagacgctc

SEQ ID NO: 121047 - DNA, 25 bp, mus musculus
cgcttcctaaaccatttgcagaaat

SEQ ID NO: 121048 - DNA, 25 bp, mus musculus
tcctaaaccatttgcagaaatataa

SEQ ID NO: 121049 - DNA, 25 bp, mus musculus
ctaaaccatttgcagaaatataagg

SEQ ID NO: 121050 - DNA, 25 bp, mus musculus
tgcgtgcatgtgcgttgttagcaac

SEQ ID NO: 121051 - DNA, 25 bp, mus musculus
cgttgttagcaacacatctaccagc

SEQ ID NO: 121052 - DNA, 25 bp, mus musculus
ttgttagcaacacatctaccagccc

SEQ ID NO: 121053 - DNA, 25 bp, mus musculus
tagcaacacatctaccagccctctg

SEQ ID NO: 121054 - DNA, 25 bp, mus musculus
taccagccctctgcatgactgaggt

SEQ ID NO: 121055 - DNA, 25 bp, mus musculus
ccagccctctgcatgactgaggttg

SEQ ID NO: 121056 - DNA, 25 bp, mus musculus
gaatctgacccagtggctgatggtg

SEQ ID NO: 121057 - DNA, 25 bp, mus musculus
atctgacccagtggctgatggtgct

SEQ ID NO: 121058 - DNA, 25 bp, mus musculus
gacccagtggctgatggtgctgaaa

SEQ ID NO: 121059 - DNA, 25 bp, mus musculus
cccagtggctgatggtgctgaaaat

SEQ ID NO: 121060 - DNA, 25 bp, mus musculus
gctgaaaatctccttgcctgtgatc

SEQ ID NO: 121061 - DNA, 25 bp, mus musculus
tgaaaatctccttgcctgtgatcct

SEQ ID NO: 121062 - DNA, 25 bp, mus musculus
aatctccttgcctgtgatcctcatg

SEQ ID NO: 121063 - DNA, 25 bp, mus musculus
tctccttgcctgtgatcctcatgga

SEQ ID NO: 121064 - DNA, 25 bp, mus musculus
ctggtgttgcttcaagctagtaatt

SEQ ID NO: 121065 - DNA, 25 bp, mus musculus
cttatcccaaagctctgaggccata

SEQ ID NO: 121066 - DNA, 25 bp, mus musculus
tcagcacaagttcatctccactagg

SEQ ID NO: 121067 - DNA, 25 bp, mus musculus
caagttcatctccactaggttccac

SEQ ID NO: 121068 - DNA, 25 bp, mus musculus
cccgccatgacctcagagctagaag

SEQ ID NO: 121069 - DNA, 25 bp, mus musculus
atgacctcagagctagaagtctgtg

SEQ ID NO: 121070 - DNA, 25 bp, mus musculus
ttctccctgctgcacagaggatacc

SEQ ID NO: 121071 - DNA, 25 bp, mus musculus
cagcctgatgtagcccagactccta

SEQ ID NO: 121072 - DNA, 25 bp, mus musculus
gaattctgttgctcaaactgccata

SEQ ID NO: 121073 - DNA, 25 bp, mus musculus
gcagcccaaagaaactaacatagat

SEQ ID NO: 121074 - DNA, 25 bp, mus musculus
gaaccctgacatccctacatgaatg

SEQ ID NO: 121075 - DNA, 25 bp, mus musculus
tgacatccctacatgaatgttggtt

SEQ ID NO: 121076 - DNA, 25 bp, mus musculus
ccaaagctctgaggccatagcagtt

SEQ ID NO: 121077 - DNA, 25 bp, mus musculus
atccttgtctcctggcaccaacatc

SEQ ID NO: 121078 - DNA, 25 bp, mus musculus
tggcaccaacatcccagtcactgta

SEQ ID NO: 121079 - DNA, 25 bp, mus musculus
caacatcccagtcactgtatgtcct

SEQ ID NO: 121080 - DNA, 25 bp, mus musculus
cccagtcactgtatgtcctttgtac

SEQ ID NO: 121081 - DNA, 25 bp, mus musculus
cactgtatgtcctttgtacctaatg

SEQ ID NO: 121082 - DNA, 25 bp, mus musculus
tttgatgccaaccctgattcagcac

SEQ ID NO: 121083 - DNA, 25 bp, mus musculus
gccaaccctgattcagcacaagttc

SEQ ID NO: 121084 - DNA, 25 bp, mus musculus
cccggagctgagctaccgaaggctt

SEQ ID NO: 121085 - DNA, 25 bp, mus musculus
agctgagctaccgaaggcttctctc

SEQ ID NO: 121086 - DNA, 25 bp, mus musculus
catcttgttactgctcaatatctgg

SEQ ID NO: 121087 - DNA, 25 bp, mus musculus
atcttgttactgctcaatatctgga

SEQ ID NO: 121088 - DNA, 25 bp, mus musculus
ttgttactgctcaatatctggaagt

SEQ ID NO: 121089 - DNA, 25 bp, mus musculus
gttactgctcaatatctggaagtcc

SEQ ID NO: 121090 - DNA, 25 bp, mus musculus
ttactgctcaatatctggaagtccc

SEQ ID NO: 121091 - DNA, 25 bp, mus musculus
actgctcaatatctggaagtcccga

SEQ ID NO: 121092 - DNA, 25 bp, mus musculus
caatatctggaagtcccgatcgtgt

SEQ ID NO: 121093 - DNA, 25 bp, mus musculus
gaagagccaagtcctgtttgctgtg

SEQ ID NO: 121094 - DNA, 25 bp, mus musculus
aagagccaagtcctgtttgctgtgg

SEQ ID NO: 121095 - DNA, 25 bp, mus musculus
gagccaagtcctgtttgctgtggtg

SEQ ID NO: 121096 - DNA, 25 bp, mus musculus
gctgagctaccgaaggcttctctcc

SEQ ID NO: 121097 - DNA, 25 bp, mus musculus
agccaagtcctgtttgctgtggtgt

SEQ ID NO: 121098 - DNA, 25 bp, mus musculus
gagtcccccagtcatgaacctcttc

SEQ ID NO: 121099 - DNA, 25 bp, mus musculus
catgaacctcttccgattcctggga

SEQ ID NO: 121100 - DNA, 25 bp, mus musculus
ctcctagctatcatcttgttactgc

SEQ ID NO: 121101 - DNA, 25 bp, mus musculus
cctagctatcatcttgttactgctc

SEQ ID NO: 121102 - DNA, 25 bp, mus musculus
ctagctatcatcttgttactgctca

SEQ ID NO: 121103 - DNA, 25 bp, mus musculus
agctatcatcttgttactgctcaat

SEQ ID NO: 121104 - DNA, 25 bp, mus musculus
tatcatcttgttactgctcaatatc

SEQ ID NO: 121105 - DNA, 25 bp, mus musculus
acattaagagacacctgttggtcca

SEQ ID NO: 121106 - DNA, 25 bp, mus musculus
ttaagagacacctgttggtccatgc

SEQ ID NO: 121107 - DNA, 25 bp, mus musculus
atggtgtctacatccttgacttggc

SEQ ID NO: 121108 - DNA, 25 bp, mus musculus
tctacatccttgacttggcggccat

SEQ ID NO: 121109 - DNA, 25 bp, mus musculus
acatccttgacttggcggccatcga

SEQ ID NO: 121110 - DNA, 25 bp, mus musculus
tccttgacttggcggccatcgagta

SEQ ID NO: 121111 - DNA, 25 bp, mus musculus
acttggcggccatcgagtaaaatcg

SEQ ID NO: 121112 - DNA, 25 bp, mus musculus
gataaacaacccagacatgcgagtg

SEQ ID NO: 121113 - DNA, 25 bp, mus musculus
caacccagacatgcgagtgcagatc

SEQ ID NO: 121114 - DNA, 25 bp, mus musculus
gcagatcctcaaggacttcgtcaaa

SEQ ID NO: 121115 - DNA, 25 bp, mus musculus
gatcctcaaggacttcgtcaaacag

SEQ ID NO: 121116 - DNA, 25 bp, mus musculus
cctcaaggacttcgtcaaacagcac

SEQ ID NO: 121117 - DNA, 25 bp, mus musculus
agagacacctgttggtccatgcacc

SEQ ID NO: 121118 - DNA, 25 bp, mus musculus
acctgttggtccatgcacctgagga

SEQ ID NO: 121119 - DNA, 25 bp, mus musculus
tggccagcttcatctctggtctatt

SEQ ID NO: 121120 - DNA, 25 bp, mus musculus
ccagcttcatctctggtctattcaa

SEQ ID NO: 121121 - DNA, 25 bp, mus musculus
tcatctctggtctattcaatttcta

SEQ ID NO: 121122 - DNA, 25 bp, mus musculus
tctctggtctattcaatttctacga

SEQ ID NO: 121123 - DNA, 25 bp, mus musculus
aggatctgtacttcacctaccttga

SEQ ID NO: 121124 - DNA, 25 bp, mus musculus
atctgtacttcacctaccttgagat

SEQ ID NO: 121125 - DNA, 25 bp, mus musculus
gcttacggcctgtgacaggcagtgt

SEQ ID NO: 121126 - DNA, 25 bp, mus musculus
gtgccccatgcagcgggaatgtggc

SEQ ID NO: 121127 - DNA, 25 bp, mus musculus
cagctacctgctggcaaggggcttg

SEQ ID NO: 121128 - DNA, 25 bp, mus musculus
aaggggcttgctgctgatagatcag

SEQ ID NO: 121129 - DNA, 25 bp, mus musculus
gctgatagatcagcctcctgcctca

SEQ ID NO: 121130 - DNA, 25 bp, mus musculus
tcctgcctcagctgcagccctggga

SEQ ID NO: 121131 - DNA, 25 bp, mus musculus
agctgcagccctgggaatacccagt

SEQ ID NO: 121132 - DNA, 25 bp, mus musculus
tgcagccctgggaatacccagtgct

SEQ ID NO: 121133 - DNA, 25 bp, mus musculus
aatacccagtgctgtttcctgtgcc

SEQ ID NO: 121134 - DNA, 25 bp, mus musculus
ctgtgcctctggcctctaggcctgt

SEQ ID NO: 121135 - DNA, 25 bp, mus musculus
ctctggcctctaggcctgttgtgca

SEQ ID NO: 121136 - DNA, 25 bp, mus musculus
cctctaggcctgttgtgcaataaac

SEQ ID NO: 121137 - DNA, 25 bp, mus musculus
ccccatgcagcgggaatgtggcagt

SEQ ID NO: 121138 - DNA, 25 bp, mus musculus
tggcctggactacaaggctaagcat

SEQ ID NO: 121139 - DNA, 25 bp, mus musculus
tagcttcaaggtctgctgcccttgt

SEQ ID NO: 121140 - DNA, 25 bp, mus musculus
cttcaaggtctgctgcccttgtgtt

SEQ ID NO: 121141 - DNA, 25 bp, mus musculus
ggtctgctgcccttgtgttctgaga

SEQ ID NO: 121142 - DNA, 25 bp, mus musculus
ctgcccttgtgttctgagaatacat

SEQ ID NO: 121143 - DNA, 25 bp, mus musculus
agcagctgccactccattcagctac

SEQ ID NO: 121144 - DNA, 25 bp, mus musculus
cactccattcagctacctgctggca

SEQ ID NO: 121145 - DNA, 25 bp, mus musculus
ccattctatttattcactgagcttc

SEQ ID NO: 121146 - DNA, 25 bp, mus musculus
tatttattcactgagcttctctgtg

SEQ ID NO: 121147 - DNA, 25 bp, mus musculus
atcctttgatgatcattcctgcagc

SEQ ID NO: 121148 - DNA, 25 bp, mus musculus
tgatgatcattcctgcagcagctca

SEQ ID NO: 121149 - DNA, 25 bp, mus musculus
tcattcctgcagcagctcagagggt

SEQ ID NO: 121150 - DNA, 25 bp, mus musculus
ccagccgcttcatccctgaaaactg

SEQ ID NO: 121151 - DNA, 25 bp, mus musculus
gcttcatccctgaaaactgtggcca

SEQ ID NO: 121152 - DNA, 25 bp, mus musculus
tccctgaaaactgtggccagtttgt

SEQ ID NO: 121153 - DNA, 25 bp, mus musculus
aatgcaattcctctgggaatggtgt

SEQ ID NO: 121154 - DNA, 25 bp, mus musculus
attcctctgggaatggtgtattgtt

SEQ ID NO: 121155 - DNA, 25 bp, mus musculus
ttgtctgcctttgtagcagcatcta

SEQ ID NO: 121156 - DNA, 25 bp, mus musculus
gcctttgtagcagcatctaattttg

SEQ ID NO: 121157 - DNA, 25 bp, mus musculus
gagcttctctgtgaactatttagaa

SEQ ID NO: 121158 - DNA, 25 bp, mus musculus
gctgtttccattggggacactttat

SEQ ID NO: 121159 - DNA, 25 bp, mus musculus
ctattctaaggctggccacacttga

SEQ ID NO: 121160 - DNA, 25 bp, mus musculus
tggccacacttgagagctgcagggc

SEQ ID NO: 121161 - DNA, 25 bp, mus musculus
cacttgagagctgcagggccctttg

SEQ ID NO: 121162 - DNA, 25 bp, mus musculus
tttcaattgctctcatccctgagtt

SEQ ID NO: 121163 - DNA, 25 bp, mus musculus
ttgctctcatccctgagttcagagc

SEQ ID NO: 121164 - DNA, 25 bp, mus musculus
tcatgggtcttgggaagagaaacca

SEQ ID NO: 121165 - DNA, 25 bp, mus musculus
gcaacttatgtcaagcagcgtataa

SEQ ID NO: 121166 - DNA, 25 bp, mus musculus
caacttatgtcaagcagcgtataac

SEQ ID NO: 121167 - DNA, 25 bp, mus musculus
agaagtgtcagagtccctggatact

SEQ ID NO: 121168 - DNA, 25 bp, mus musculus
aagtgtcagagtccctggatactgc

SEQ ID NO: 121169 - DNA, 25 bp, mus musculus
agagtccctggatactgcagaccct

SEQ ID NO: 121170 - DNA, 25 bp, mus musculus
caccggtgccaagcagggcacgagc

SEQ ID NO: 121171 - DNA, 25 bp, mus musculus
gcacgagctcaccgaccagcaggcg

SEQ ID NO: 121172 - DNA, 25 bp, mus musculus
gaccagcaggcgccacctcatcagg

SEQ ID NO: 121173 - DNA, 25 bp, mus musculus
ccagcaggcgccacctcatcaggat

SEQ ID NO: 121174 - DNA, 25 bp, mus musculus
cagcaggcgccacctcatcaggatt

SEQ ID NO: 121175 - DNA, 25 bp, mus musculus
gcaggcgccacctcatcaggattgt

SEQ ID NO: 121176 - DNA, 25 bp, mus musculus
caggcgccacctcatcaggattgtg

SEQ ID NO: 121177 - DNA, 25 bp, mus musculus
atgtcaagcagcgtataacgtctgg

SEQ ID NO: 121178 - DNA, 25 bp, mus musculus
cagcgtataacgtctggtggcgtga

SEQ ID NO: 121179 - DNA, 25 bp, mus musculus
agcgtataacgtctggtggcgtgat

SEQ ID NO: 121180 - DNA, 25 bp, mus musculus
cgtataacgtctggtggcgtgatct

SEQ ID NO: 121181 - DNA, 25 bp, mus musculus
ataacgtctggtggcgtgatctgtg

SEQ ID NO: 121182 - DNA, 25 bp, mus musculus
taacgtctggtggcgtgatctgtga

SEQ ID NO: 121183 - DNA, 25 bp, mus musculus
cgtctggtggcgtgatctgtgagaa

SEQ ID NO: 121184 - DNA, 25 bp, mus musculus
tctggtggcgtgatctgtgagaagt

SEQ ID NO: 121185 - DNA, 25 bp, mus musculus
agtgcatctgctaggcatggcagag

SEQ ID NO: 121186 - DNA, 25 bp, mus musculus
gcatctgctaggcatggcagagacg

SEQ ID NO: 121187 - DNA, 25 bp, mus musculus
ctcctgcacacctgagtactcatgg

SEQ ID NO: 121188 - DNA, 25 bp, mus musculus
ctgcacacctgagtactcatggaag

SEQ ID NO: 121189 - DNA, 25 bp, mus musculus
cacacctgagtactcatggaaggac

SEQ ID NO: 121190 - DNA, 25 bp, mus musculus
acctgagtactcatggaaggactga

SEQ ID NO: 121191 - DNA, 25 bp, mus musculus
ctgactagcacaaggcagggccctg

SEQ ID NO: 121192 - DNA, 25 bp, mus musculus
tcaatggtactcaatgccagccgga

SEQ ID NO: 121193 - DNA, 25 bp, mus musculus
atggtactcaatgccagccggaggc

SEQ ID NO: 121194 - DNA, 25 bp, mus musculus
gtactcaatgccagccggaggccct

SEQ ID NO: 121195 - DNA, 25 bp, mus musculus
ctcaatgccagccggaggccctgca

SEQ ID NO: 121196 - DNA, 25 bp, mus musculus
aatgccagccggaggccctgcatgg

SEQ ID NO: 121197 - DNA, 25 bp, mus musculus
gggcattcagcgcatagacgtacag

SEQ ID NO: 121198 - DNA, 25 bp, mus musculus
cattcagcgcatagacgtacagcat

SEQ ID NO: 121199 - DNA, 25 bp, mus musculus
cgtacagcatgaacatcagaccctg

SEQ ID NO: 121200 - DNA, 25 bp, mus musculus
gcatgaacatcagaccctgcgcaac

SEQ ID NO: 121201 - DNA, 25 bp, mus musculus
tgaacatcagaccctgcgcaacaat

SEQ ID NO: 121202 - DNA, 25 bp, mus musculus
acatcagaccctgcgcaacaatgga

SEQ ID NO: 121203 - DNA, 25 bp, mus musculus
tcagaccctgcgcaacaatggaact

SEQ ID NO: 121204 - DNA, 25 bp, mus musculus
gaccctgcgcaacaatggaacttgc

SEQ ID NO: 121205 - DNA, 25 bp, mus musculus
atcagcacctcacaagcagagcaca

SEQ ID NO: 121206 - DNA, 25 bp, mus musculus
acctcacaagcagagcacaagcctg

SEQ ID NO: 121207 - DNA, 25 bp, mus musculus
tcggccaagacaggtcgctcagggt

SEQ ID NO: 121208 - DNA, 25 bp, mus musculus
aagacaggtcgctcagggtcacaag

SEQ ID NO: 121209 - DNA, 25 bp, mus musculus
gaaaccatggcacattctgttcaaa

SEQ ID NO: 121210 - DNA, 25 bp, mus musculus
tttcctccttgcctctgatgggcaa

SEQ ID NO: 121211 - DNA, 25 bp, mus musculus
ccttgcctctgatgggcaaccactt

SEQ ID NO: 121212 - DNA, 25 bp, mus musculus
ttaggcagcactctctagaacagaa

SEQ ID NO: 121213 - DNA, 25 bp, mus musculus
ggtcatagccttgcacttgaggtct

SEQ ID NO: 121214 - DNA, 25 bp, mus musculus
agccttgcacttgaggtctttcatt

SEQ ID NO: 121215 - DNA, 25 bp, mus musculus
gcacttgaggtctttcattgaagct

SEQ ID NO: 121216 - DNA, 25 bp, mus musculus
agcacattgctttgatgagtatgaa

SEQ ID NO: 121217 - DNA, 25 bp, mus musculus
gagcacaagcctgtcttcctgggaa

SEQ ID NO: 121218 - DNA, 25 bp, mus musculus
ataattgacttcaccatggaatctg

SEQ ID NO: 121219 - DNA, 25 bp, mus musculus
gaatctgtgtcttcctaaagtatgg

SEQ ID NO: 121220 - DNA, 25 bp, mus musculus
gtgtcttcctaaagtatgggctgga

SEQ ID NO: 121221 - DNA, 25 bp, mus musculus
gctcccttgtcatgaatgagcagac

SEQ ID NO: 121222 - DNA, 25 bp, mus musculus
cagctcaatctctaggacactcctt

SEQ ID NO: 121223 - DNA, 25 bp, mus musculus
aatctctaggacactccttagtcct

SEQ ID NO: 121224 - DNA, 25 bp, mus musculus
taggacactccttagtcctcggcca

SEQ ID NO: 121225 - DNA, 25 bp, mus musculus
ccctcgcgacagagctccagtgtag

SEQ ID NO: 121226 - DNA, 25 bp, mus musculus
tcgcgacagagctccagtgtagagg

SEQ ID NO: 121227 - DNA, 25 bp, mus musculus
ttctgcctccagattcctgccttga

SEQ ID NO: 121228 - DNA, 25 bp, mus musculus
tgcctccagattcctgccttgagct

SEQ ID NO: 121229 - DNA, 25 bp, mus musculus
ctccagattcctgccttgagctcct

SEQ ID NO: 121230 - DNA, 25 bp, mus musculus
attcctgccttgagctcctgccctg

SEQ ID NO: 121231 - DNA, 25 bp, mus musculus
ttgagctcctgccctggcttctgct

SEQ ID NO: 121232 - DNA, 25 bp, mus musculus
ggcttctgctgatggacggctctca

SEQ ID NO: 121233 - DNA, 25 bp, mus musculus
tgctgatggacggctctcagacact

SEQ ID NO: 121234 - DNA, 25 bp, mus musculus
acggctctcagacactgcgcagaag

SEQ ID NO: 121235 - DNA, 25 bp, mus musculus
gctctcagacactgcgcagaagaca

SEQ ID NO: 121236 - DNA, 25 bp, mus musculus
ctcagacactgcgcagaagacagaa

SEQ ID NO: 121237 - DNA, 25 bp, mus musculus
cgacagagctccagtgtagagggcc

SEQ ID NO: 121238 - DNA, 25 bp, mus musculus
cagagctccagtgtagagggccaag

SEQ ID NO: 121239 - DNA, 25 bp, mus musculus
cctcctatctggatttaaagatagg

SEQ ID NO: 121240 - DNA, 25 bp, mus musculus
ccgtaagcagcattcctccaaggat

SEQ ID NO: 121241 - DNA, 25 bp, mus musculus
gcattcctccaaggattctgcctcc

SEQ ID NO: 121242 - DNA, 25 bp, mus musculus
ttcctccaaggattctgcctccaga

SEQ ID NO: 121243 - DNA, 25 bp, mus musculus
ctccaaggattctgcctccagattc

SEQ ID NO: 121244 - DNA, 25 bp, mus musculus
ggattctgcctccagattcctgcct

SEQ ID NO: 121245 - DNA, 25 bp, mus musculus
gaaccgccgatcttgtgacaccgga

SEQ ID NO: 121246 - DNA, 25 bp, mus musculus
ccgccgatcttgtgacaccggagtc

SEQ ID NO: 121247 - DNA, 25 bp, mus musculus
gtatctggtgtcagctgaagaccat

SEQ ID NO: 121248 - DNA, 25 bp, mus musculus
agaccatgtgtcccccaatacttag

SEQ ID NO: 121249 - DNA, 25 bp, mus musculus
ccatgtgtcccccaatacttagatt

SEQ ID NO: 121250 - DNA, 25 bp, mus musculus
tgtgtcccccaatacttagatttca

SEQ ID NO: 121251 - DNA, 25 bp, mus musculus
tacttagatttcaccgtactttctg

SEQ ID NO: 121252 - DNA, 25 bp, mus musculus
gatttcaccgtactttctgatggtg

SEQ ID NO: 121253 - DNA, 25 bp, mus musculus
ttcaccgtactttctgatggtgttt

SEQ ID NO: 121254 - DNA, 25 bp, mus musculus
gtttgcacgtgcaaccgtatattaa

SEQ ID NO: 121255 - DNA, 25 bp, mus musculus
ataattctgcagcagatgccaaatg

SEQ ID NO: 121256 - DNA, 25 bp, mus musculus
gttatctatcacaaaccacaaaatt

SEQ ID NO: 121257 - DNA, 25 bp, mus musculus
atcttgtgacaccggagtctgaggt

SEQ ID NO: 121258 - DNA, 25 bp, mus musculus
tgacaccggagtctgaggtggaaca

SEQ ID NO: 121259 - DNA, 25 bp, mus musculus
aacagagccagtgtcaggaaagccc

SEQ ID NO: 121260 - DNA, 25 bp, mus musculus
gtcaggaaagcccctcagcaagaaa

SEQ ID NO: 121261 - DNA, 25 bp, mus musculus
attgctggttcccaggggcagtcac

SEQ ID NO: 121262 - DNA, 25 bp, mus musculus
atgaaataccacatcaaggcagtgg

SEQ ID NO: 121263 - DNA, 25 bp, mus musculus
gtgggaacttcctgcgacttctcct

SEQ ID NO: 121264 - DNA, 25 bp, mus musculus
ggaacttcctgcgacttctcctggt

SEQ ID NO: 121265 - DNA, 25 bp, mus musculus
aaccagccaacagtgcggatcacgg

SEQ ID NO: 121266 - DNA, 25 bp, mus musculus
cagccaacagtgcggatcacggaac

SEQ ID NO: 121267 - DNA, 25 bp, mus musculus
agggtcttcatcgcagaggtgccca

SEQ ID NO: 121268 - DNA, 25 bp, mus musculus
gtcttcatcgcagaggtgcccataa

SEQ ID NO: 121269 - DNA, 25 bp, mus musculus
atcgcagaggtgcccataatagcca

SEQ ID NO: 121270 - DNA, 25 bp, mus musculus
gtgcccataatagccatcgactggg

SEQ ID NO: 121271 - DNA, 25 bp, mus musculus
ataatagccatcgactgggttcaga

SEQ ID NO: 121272 - DNA, 25 bp, mus musculus
atagccatcgactgggttcagattg

SEQ ID NO: 121273 - DNA, 25 bp, mus musculus
gccatcgactgggttcagattgacg

SEQ ID NO: 121274 - DNA, 25 bp, mus musculus
aactcctcggtccttcatgatgaat

SEQ ID NO: 121275 - DNA, 25 bp, mus musculus
tcctcggtccttcatgatgaattca

SEQ ID NO: 121276 - DNA, 25 bp, mus musculus
tcggtccttcatgatgaattcatcg

SEQ ID NO: 121277 - DNA, 25 bp, mus musculus
ccaacagtgcggatcacggaactca

SEQ ID NO: 121278 - DNA, 25 bp, mus musculus
cggatcacggaactcaccgaagaga

SEQ ID NO: 121279 - DNA, 25 bp, mus musculus
atcacggaactcaccgaagagaacg

SEQ ID NO: 121280 - DNA, 25 bp, mus musculus
ctcaccgaagagaacgtcaagttca

SEQ ID NO: 121281 - DNA, 25 bp, mus musculus
ttcattatcgagaacacggacctgg

SEQ ID NO: 121282 - DNA, 25 bp, mus musculus
gtggccaattccattcggagggtct

SEQ ID NO: 121283 - DNA, 25 bp, mus musculus
gccaattccattcggagggtcttca

SEQ ID NO: 121284 - DNA, 25 bp, mus musculus
aattccattcggagggtcttcatcg

SEQ ID NO: 121285 - DNA, 25 bp, mus musculus
gaattgagcatcccagacagtggtc

SEQ ID NO: 121286 - DNA, 25 bp, mus musculus
ttgagcatcccagacagtggtccat

SEQ ID NO: 121287 - DNA, 25 bp, mus musculus
cagcctagctcattccctgagatca

SEQ ID NO: 121288 - DNA, 25 bp, mus musculus
cctagctcattccctgagatcacta

SEQ ID NO: 121289 - DNA, 25 bp, mus musculus
agctcattccctgagatcactaaca

SEQ ID NO: 121290 - DNA, 25 bp, mus musculus
tcattccctgagatcactaacacta

SEQ ID NO: 121291 - DNA, 25 bp, mus musculus
ttccctgagatcactaacactactg

SEQ ID NO: 121292 - DNA, 25 bp, mus musculus
cctgagatcactaacactactgaac

SEQ ID NO: 121293 - DNA, 25 bp, mus musculus
gagatcactaacactactgaacata

SEQ ID NO: 121294 - DNA, 25 bp, mus musculus
atcactaacactactgaacatagtc

SEQ ID NO: 121295 - DNA, 25 bp, mus musculus
actaacactactgaacatagtcatt

SEQ ID NO: 121296 - DNA, 25 bp, mus musculus
aacactactgaacatagtcattctg

SEQ ID NO: 121297 - DNA, 25 bp, mus musculus
agcatcccagacagtggtccatacg

SEQ ID NO: 121298 - DNA, 25 bp, mus musculus
atcccagacagtggtccatacgggc

SEQ ID NO: 121299 - DNA, 25 bp, mus musculus
ccagacagtggtccatacgggcctc

SEQ ID NO: 121300 - DNA, 25 bp, mus musculus
agtggtccatacgggcctcagccta

SEQ ID NO: 121301 - DNA, 25 bp, mus musculus
ccatacgggcctcagcctagctcat

SEQ ID NO: 121302 - DNA, 25 bp, mus musculus
tacgggcctcagcctagctcattcc

SEQ ID NO: 121303 - DNA, 25 bp, mus musculus
gggcctcagcctagctcattccctg

SEQ ID NO: 121304 - DNA, 25 bp, mus musculus
cctcagcctagctcattccctgaga

SEQ ID NO: 121305 - DNA, 25 bp, mus musculus
aactactagtcttcagatgataaat

SEQ ID NO: 121306 - DNA, 25 bp, mus musculus
tactagtcttcagatgataaatatg

SEQ ID NO: 121307 - DNA, 25 bp, mus musculus
aattcatcttcacctgataaagatg

SEQ ID NO: 121308 - DNA, 25 bp, mus musculus
tcatcttcacctgataaagatggtt

SEQ ID NO: 121309 - DNA, 25 bp, mus musculus
tcttcacctgataaagatggttgct

SEQ ID NO: 121310 - DNA, 25 bp, mus musculus
tttggaatctacacctgcacactta

SEQ ID NO: 121311 - DNA, 25 bp, mus musculus
ggaatctacacctgcacacttatac

SEQ ID NO: 121312 - DNA, 25 bp, mus musculus
tacacctgcacacttatacttcttc

SEQ ID NO: 121313 - DNA, 25 bp, mus musculus
acctgcacacttatacttcttccgt

SEQ ID NO: 121314 - DNA, 25 bp, mus musculus
tgcacacttatacttcttccgtcct

SEQ ID NO: 121315 - DNA, 25 bp, mus musculus
aggaatatctcacatttcttacatt

SEQ ID NO: 121316 - DNA, 25 bp, mus musculus
cattttccttttaagtgctgattga

SEQ ID NO: 121317 - DNA, 25 bp, mus musculus
ataagctcagatgtctgtcattttt

SEQ ID NO: 121318 - DNA, 25 bp, mus musculus
agctcagatgtctgtcatttttagg

SEQ ID NO: 121319 - DNA, 25 bp, mus musculus
gatgtctgtcatttttaggacagca

SEQ ID NO: 121320 - DNA, 25 bp, mus musculus
gatctcctctccagggagctaacat

SEQ ID NO: 121321 - DNA, 25 bp, mus musculus
ctcctctccagggagctaacatcag

SEQ ID NO: 121322 - DNA, 25 bp, mus musculus
ctctccagggagctaacatcagctc

SEQ ID NO: 121323 - DNA, 25 bp, mus musculus
gagctaacatcagctcagagtttac

SEQ ID NO: 121324 - DNA, 25 bp, mus musculus
acatcagctcagagtttactgaaga

SEQ ID NO: 121325 - DNA, 25 bp, mus musculus
tccccttgcggctgtgaccactgct

SEQ ID NO: 121326 - DNA, 25 bp, mus musculus
ccccttgcggctgtgaccactgctg

SEQ ID NO: 121327 - DNA, 25 bp, mus musculus
gaccctatcaacgacctgcaactca

SEQ ID NO: 121328 - DNA, 25 bp, mus musculus
ccctatcaacgacctgcaactcaag

SEQ ID NO: 121329 - DNA, 25 bp, mus musculus
tatcaacgacctgcaactcaaggat

SEQ ID NO: 121330 - DNA, 25 bp, mus musculus
atcaacgacctgcaactcaaggatg

SEQ ID NO: 121331 - DNA, 25 bp, mus musculus
caacgacctgcaactcaaggatgtg

SEQ ID NO: 121332 - DNA, 25 bp, mus musculus
aacgacctgcaactcaaggatgtgg

SEQ ID NO: 121333 - DNA, 25 bp, mus musculus
gacctgcaactcaaggatgtggcag

SEQ ID NO: 121334 - DNA, 25 bp, mus musculus
caactcaaggatgtggcagtggtag

SEQ ID NO: 121335 - DNA, 25 bp, mus musculus
actcaaggatgtggcagtggtagaa

SEQ ID NO: 121336 - DNA, 25 bp, mus musculus
aagctgcgggacgaatgcagattca

SEQ ID NO: 121337 - DNA, 25 bp, mus musculus
gcggctgtgaccactgctgttcagg

SEQ ID NO: 121338 - DNA, 25 bp, mus musculus
ggctgtgaccactgctgttcaggag

SEQ ID NO: 121339 - DNA, 25 bp, mus musculus
tgtgaccactgctgttcaggagctg

SEQ ID NO: 121340 - DNA, 25 bp, mus musculus
gtgaccactgctgttcaggagctgc

SEQ ID NO: 121341 - DNA, 25 bp, mus musculus
ctggctcagtcctatccagcaggac

SEQ ID NO: 121342 - DNA, 25 bp, mus musculus
ggctcagtcctatccagcaggaccc

SEQ ID NO: 121343 - DNA, 25 bp, mus musculus
ccttgaccctatcaacgacctgcaa

SEQ ID NO: 121344 - DNA, 25 bp, mus musculus
cttgaccctatcaacgacctgcaac

SEQ ID NO: 121345 - DNA, 25 bp, mus musculus
gtctgtcattgaccttgaattgaga

SEQ ID NO: 121346 - DNA, 25 bp, mus musculus
atcatatgcagatgcttgttggcca

SEQ ID NO: 121347 - DNA, 25 bp, mus musculus
tctcatgggcctgaggcatacttct

SEQ ID NO: 121348 - DNA, 25 bp, mus musculus
caccctcttggttggccaatgtctg

SEQ ID NO: 121349 - DNA, 25 bp, mus musculus
tggccaatgtctggcatctgtattc

SEQ ID NO: 121350 - DNA, 25 bp, mus musculus
atgtctggcatctgtattcttgatg

SEQ ID NO: 121351 - DNA, 25 bp, mus musculus
ggcatctgtattcttgatgattgtt

SEQ ID NO: 121352 - DNA, 25 bp, mus musculus
gattgttcctttttcatccactctg

SEQ ID NO: 121353 - DNA, 25 bp, mus musculus
tctgaaagcctcttgatctcctttg

SEQ ID NO: 121354 - DNA, 25 bp, mus musculus
agcctcttgatctcctttgtgaatg

SEQ ID NO: 121355 - DNA, 25 bp, mus musculus
atgactgctatcagttttgtaggga

SEQ ID NO: 121356 - DNA, 25 bp, mus musculus
tgaaagtccactcaggaagcagttt

SEQ ID NO: 121357 - DNA, 25 bp, mus musculus
ttggccaagagcactactataaaga

SEQ ID NO: 121358 - DNA, 25 bp, mus musculus
ctctgtatatttgctcctacaacta

SEQ ID NO: 121359 - DNA, 25 bp, mus musculus
atatttgctcctacaactaatgcct

SEQ ID NO: 121360 - DNA, 25 bp, mus musculus
gctcctacaactaatgcctttaaga

SEQ ID NO: 121361 - DNA, 25 bp, mus musculus
acaactaatgcctttaagactgagc

SEQ ID NO: 121362 - DNA, 25 bp, mus musculus
actgagctacctgtaccatggtctg

SEQ ID NO: 121363 - DNA, 25 bp, mus musculus
atgatataagcctctcatgggcctg

SEQ ID NO: 121364 - DNA, 25 bp, mus musculus
taagcctctcatgggcctgaggcat

SEQ ID NO: 121365 - DNA, 25 bp, mus musculus
gctcacctggcaacacagatggagg

SEQ ID NO: 121366 - DNA, 25 bp, mus musculus
cagaagaaccatctagcaagctaga

SEQ ID NO: 121367 - DNA, 25 bp, mus musculus
gcaactctatcactaaactggactt

SEQ ID NO: 121368 - DNA, 25 bp, mus musculus
ctatcactaaactggactttgccat

SEQ ID NO: 121369 - DNA, 25 bp, mus musculus
ctaaactggactttgccattgaaga

SEQ ID NO: 121370 - DNA, 25 bp, mus musculus
aataggatctaaccacttcagcaca

SEQ ID NO: 121371 - DNA, 25 bp, mus musculus
atctaaccacttcagcacagcagtt

SEQ ID NO: 121372 - DNA, 25 bp, mus musculus
ccacttcagcacagcagttctaaag

SEQ ID NO: 121373 - DNA, 25 bp, mus musculus
gcccaacagtgctctgtgtgttttg

SEQ ID NO: 121374 - DNA, 25 bp, mus musculus
gtgtatatctgttgatcgggagctg

SEQ ID NO: 121375 - DNA, 25 bp, mus musculus
atctgttgatcgggagctgagatgg

SEQ ID NO: 121376 - DNA, 25 bp, mus musculus
tcacttttcatgtaacatatagtat

SEQ ID NO: 121377 - DNA, 25 bp, mus musculus
aaccatctagcaagctagaaaagtc

SEQ ID NO: 121378 - DNA, 25 bp, mus musculus
agtaaaactcagcactaatgtaaat

SEQ ID NO: 121379 - DNA, 25 bp, mus musculus
gaatcacaaagctcaagccaaatct

SEQ ID NO: 121380 - DNA, 25 bp, mus musculus
caaagctcaagccaaatctgagacg

SEQ ID NO: 121381 - DNA, 25 bp, mus musculus
tgagacgtccaagcattcacctaat

SEQ ID NO: 121382 - DNA, 25 bp, mus musculus
gtccaagcattcacctaatcggctg

SEQ ID NO: 121383 - DNA, 25 bp, mus musculus
gcattcacctaatcggctgtttcct

SEQ ID NO: 121384 - DNA, 25 bp, mus musculus
tcggctgtttccttctgatccctgg

SEQ ID NO: 121385 - DNA, 25 bp, mus musculus
ttctgatccctgggtttctagaaca

SEQ ID NO: 121386 - DNA, 25 bp, mus musculus
tataaacctgggaacccctctgctg

SEQ ID NO: 121387 - DNA, 25 bp, mus musculus
tgggaacccctctgctgcagcagta

SEQ ID NO: 121388 - DNA, 25 bp, mus musculus
caaagtcatcatcaaacactgtgga

SEQ ID NO: 121389 - DNA, 25 bp, mus musculus
aagtcatcatcaaacactgtggaaa

SEQ ID NO: 121390 - DNA, 25 bp, mus musculus
gtcatcatcaaacactgtggaaagt

SEQ ID NO: 121391 - DNA, 25 bp, mus musculus
tcatcaaacactgtggaaagtacat

SEQ ID NO: 121392 - DNA, 25 bp, mus musculus
agtacatctttatacaataaagtcg

SEQ ID NO: 121393 - DNA, 25 bp, mus musculus
tacaataaagtcgctgcccaagggg

SEQ ID NO: 121394 - DNA, 25 bp, mus musculus
caataaagtcgctgcccaaggggag

SEQ ID NO: 121395 - DNA, 25 bp, mus musculus
gtttgctgtccctgaaagctgagta

SEQ ID NO: 121396 - DNA, 25 bp, mus musculus
ttgctgtccctgaaagctgagtata

SEQ ID NO: 121397 - DNA, 25 bp, mus musculus
gctgtccctgaaagctgagtataaa

SEQ ID NO: 121398 - DNA, 25 bp, mus musculus
cccctctgctgcagcagtacagact

SEQ ID NO: 121399 - DNA, 25 bp, mus musculus
cctctgctgcagcagtacagactgt

SEQ ID NO: 121400 - DNA, 25 bp, mus musculus
tctgctgcagcagtacagactgttt

SEQ ID NO: 121401 - DNA, 25 bp, mus musculus
tgctgcagcagtacagactgtttct

SEQ ID NO: 121402 - DNA, 25 bp, mus musculus
actgtttctacaaagtcatcatcaa

SEQ ID NO: 121403 - DNA, 25 bp, mus musculus
tgtttctacaaagtcatcatcaaac

SEQ ID NO: 121404 - DNA, 25 bp, mus musculus
tttctacaaagtcatcatcaaacac

SEQ ID NO: 121405 - DNA, 25 bp, mus musculus
tacaaagtcatcatcaaacactgtg

SEQ ID NO: 121406 - DNA, 25 bp, mus musculus
ccaatagctctggggagcaggccag

SEQ ID NO: 121407 - DNA, 25 bp, mus musculus
cagaaggcaaccttcatgggcaaga

SEQ ID NO: 121408 - DNA, 25 bp, mus musculus
taatatagcaggtggccaggactgg

SEQ ID NO: 121409 - DNA, 25 bp, mus musculus
ttgaggacagtccactgctgaggac

SEQ ID NO: 121410 - DNA, 25 bp, mus musculus
aatcatccacttctgaactccattt

SEQ ID NO: 121411 - DNA, 25 bp, mus musculus
ctgaactccatttgctacttcctgg

SEQ ID NO: 121412 - DNA, 25 bp, mus musculus
tccatttgctacttcctggtctaac

SEQ ID NO: 121413 - DNA, 25 bp, mus musculus
tgctacttcctggtctaaccagggt

SEQ ID NO: 121414 - DNA, 25 bp, mus musculus
gctccactgccctatttagtcatga

SEQ ID NO: 121415 - DNA, 25 bp, mus musculus
aggtcactagcttcctgtacctgcc

SEQ ID NO: 121416 - DNA, 25 bp, mus musculus
tgcttgccttcacagggcagctaga

SEQ ID NO: 121417 - DNA, 25 bp, mus musculus
ccttcacagggcagctagaacttgc

SEQ ID NO: 121418 - DNA, 25 bp, mus musculus
gcaaccttcatgggcaagatcagga

SEQ ID NO: 121419 - DNA, 25 bp, mus musculus
ccctgaacaccgatgcctatctgtc

SEQ ID NO: 121420 - DNA, 25 bp, mus musculus
acaccgatgcctatctgtctcttca

SEQ ID NO: 121421 - DNA, 25 bp, mus musculus
atgcctatctgtctcttcaagaact

SEQ ID NO: 121422 - DNA, 25 bp, mus musculus
atctgtctcttcaagaactacaggc

SEQ ID NO: 121423 - DNA, 25 bp, mus musculus
tacaggcccaagattcagtccacct

SEQ ID NO: 121424 - DNA, 25 bp, mus musculus
cccaagattcagtccacctaatata

SEQ ID NO: 121425 - DNA, 25 bp, mus musculus
attcagtccacctaatatagcaggt

SEQ ID NO: 121426 - DNA, 25 bp, mus musculus
agttcctgctgagcaagtcagccta

SEQ ID NO: 121427 - DNA, 25 bp, mus musculus
gttcctgctgagcaagtcagcctaa

SEQ ID NO: 121428 - DNA, 25 bp, mus musculus
aactcctggctgtcattgacattgt

SEQ ID NO: 121429 - DNA, 25 bp, mus musculus
ctcctggctgtcattgacattgtct

SEQ ID NO: 121430 - DNA, 25 bp, mus musculus
tcctggctgtcattgacattgtcta

SEQ ID NO: 121431 - DNA, 25 bp, mus musculus
acattgtctaaaaccaagatgacag

SEQ ID NO: 121432 - DNA, 25 bp, mus musculus
ctgagaggcctgacccttgttctgc

SEQ ID NO: 121433 - DNA, 25 bp, mus musculus
agaggcctgacccttgttctgcatt

SEQ ID NO: 121434 - DNA, 25 bp, mus musculus
gaggcctgacccttgttctgcattc

SEQ ID NO: 121435 - DNA, 25 bp, mus musculus
tgacccttgttctgcattctcccag

SEQ ID NO: 121436 - DNA, 25 bp, mus musculus
tcctccatctgatcccatgtgccag

SEQ ID NO: 121437 - DNA, 25 bp, mus musculus
tccatctgatcccatgtgccaggaa

SEQ ID NO: 121438 - DNA, 25 bp, mus musculus
gcaagtcagcctaatgcttaaatag

SEQ ID NO: 121439 - DNA, 25 bp, mus musculus
gtcagcctaatgcttaaatagaaca

SEQ ID NO: 121440 - DNA, 25 bp, mus musculus
cttaaatagaacaactcctggctgt

SEQ ID NO: 121441 - DNA, 25 bp, mus musculus
taaatagaacaactcctggctgtca

SEQ ID NO: 121442 - DNA, 25 bp, mus musculus
atagaacaactcctggctgtcattg

SEQ ID NO: 121443 - DNA, 25 bp, mus musculus
tagaacaactcctggctgtcattga

SEQ ID NO: 121444 - DNA, 25 bp, mus musculus
gaacaactcctggctgtcattgaca

SEQ ID NO: 121445 - DNA, 25 bp, mus musculus
caactcctggctgtcattgacattg

SEQ ID NO: 121446 - DNA, 25 bp, mus musculus
ttttccagccaggagctgagagcct

SEQ ID NO: 121447 - DNA, 25 bp, mus musculus
ttccagccaggagctgagagcctct

SEQ ID NO: 121448 - DNA, 25 bp, mus musculus
cttctcgggagctgagggctatagc

SEQ ID NO: 121449 - DNA, 25 bp, mus musculus
cagctcccagccacagatgtgcata

SEQ ID NO: 121450 - DNA, 25 bp, mus musculus
gctcccagccacagatgtgcataga

SEQ ID NO: 121451 - DNA, 25 bp, mus musculus
ctcccagccacagatgtgcatagac

SEQ ID NO: 121452 - DNA, 25 bp, mus musculus
cccagccacagatgtgcatagactc

SEQ ID NO: 121453 - DNA, 25 bp, mus musculus
agatgtgcatagactccccaacttt

SEQ ID NO: 121454 - DNA, 25 bp, mus musculus
gatgtgcatagactccccaactttg

SEQ ID NO: 121455 - DNA, 25 bp, mus musculus
tgtgcatagactccccaactttgga

SEQ ID NO: 121456 - DNA, 25 bp, mus musculus
gtgcatagactccccaactttggac

SEQ ID NO: 121457 - DNA, 25 bp, mus musculus
gcatagactccccaactttggacaa

SEQ ID NO: 121458 - DNA, 25 bp, mus musculus
tccagccaggagctgagagcctctt

SEQ ID NO: 121459 - DNA, 25 bp, mus musculus
cagccatctggatagcttctcggga

SEQ ID NO: 121460 - DNA, 25 bp, mus musculus
gccatctggatagcttctcgggagc

SEQ ID NO: 121461 - DNA, 25 bp, mus musculus
ccatctggatagcttctcgggagct

SEQ ID NO: 121462 - DNA, 25 bp, mus musculus
atctggatagcttctcgggagctga

SEQ ID NO: 121463 - DNA, 25 bp, mus musculus
tctggatagcttctcgggagctgag

SEQ ID NO: 121464 - DNA, 25 bp, mus musculus
atagcttctcgggagctgagggcta

SEQ ID NO: 121465 - DNA, 25 bp, mus musculus
tagcttctcgggagctgagggctat

SEQ ID NO: 121466 - DNA, 25 bp, mus musculus
tcctgtccatggtacccttgccact

SEQ ID NO: 121467 - DNA, 25 bp, mus musculus
tgtccatggtacccttgccactgtg

SEQ ID NO: 121468 - DNA, 25 bp, mus musculus
gatcagcccatcgcagcttgcgttc

SEQ ID NO: 121469 - DNA, 25 bp, mus musculus
cccatcgcagcttgcgttcaatcac

SEQ ID NO: 121470 - DNA, 25 bp, mus musculus
atcgcagcttgcgttcaatcacaat

SEQ ID NO: 121471 - DNA, 25 bp, mus musculus
gcagcttgcgttcaatcacaatgga

SEQ ID NO: 121472 - DNA, 25 bp, mus musculus
gcttgcgttcaatcacaatggaaac

SEQ ID NO: 121473 - DNA, 25 bp, mus musculus
tgcgttcaatcacaatggaaacata

SEQ ID NO: 121474 - DNA, 25 bp, mus musculus
catatttgcctatgcttccagctac

SEQ ID NO: 121475 - DNA, 25 bp, mus musculus
atttgcctatgcttccagctacgac

SEQ ID NO: 121476 - DNA, 25 bp, mus musculus
ctatgcttccagctacgactggtcc

SEQ ID NO: 121477 - DNA, 25 bp, mus musculus
tgcttccagctacgactggtccaag

SEQ ID NO: 121478 - DNA, 25 bp, mus musculus
ccatggtacccttgccactgtgggc

SEQ ID NO: 121479 - DNA, 25 bp, mus musculus
gcttccagctacgactggtccaagg

SEQ ID NO: 121480 - DNA, 25 bp, mus musculus
tggtacccttgccactgtgggctcc

SEQ ID NO: 121481 - DNA, 25 bp, mus musculus
tacccttgccactgtgggctccgat

SEQ ID NO: 121482 - DNA, 25 bp, mus musculus
cactgtgggctccgatggtaggttc

SEQ ID NO: 121483 - DNA, 25 bp, mus musculus
tgtgggctccgatggtaggttcagc

SEQ ID NO: 121484 - DNA, 25 bp, mus musculus
taggttcagcttctgggacaaagat

SEQ ID NO: 121485 - DNA, 25 bp, mus musculus
cagttagatcagcccatcgcagctt

SEQ ID NO: 121486 - DNA, 25 bp, mus musculus
ttagatcagcccatcgcagcttgcg

SEQ ID NO: 121487 - DNA, 25 bp, mus musculus
aaacttaactgttgcctgcctacat

SEQ ID NO: 121488 - DNA, 25 bp, mus musculus
aactgttgcctgcctacatctgcga

SEQ ID NO: 121489 - DNA, 25 bp, mus musculus
agcacctaaagtctgaatgttcctc

SEQ ID NO: 121490 - DNA, 25 bp, mus musculus
gttcctcatggcccatggtcaaaag

SEQ ID NO: 121491 - DNA, 25 bp, mus musculus
catggcccatggtcaaaaggatttt

SEQ ID NO: 121492 - DNA, 25 bp, mus musculus
tacattcctttatgccatcaaatgt

SEQ ID NO: 121493 - DNA, 25 bp, mus musculus
cctttatgccatcaaatgtcttatc

SEQ ID NO: 121494 - DNA, 25 bp, mus musculus
tgccatcaaatgtcttatcaattta

SEQ ID NO: 121495 - DNA, 25 bp, mus musculus
tggctttacctaattatgttcctat

SEQ ID NO: 121496 - DNA, 25 bp, mus musculus
ttattgccttctgtgatgtgagtat

SEQ ID NO: 121497 - DNA, 25 bp, mus musculus
tatctgttttagctgaggaggagtt

SEQ ID NO: 121498 - DNA, 25 bp, mus musculus
ggccatgttcatttgtcccttgtgg

SEQ ID NO: 121499 - DNA, 25 bp, mus musculus
cctacatctgcgaatgactctgcgc

SEQ ID NO: 121500 - DNA, 25 bp, mus musculus
tctgcgaatgactctgcgctgccag

SEQ ID NO: 121501 - DNA, 25 bp, mus musculus
aatgactctgcgctgccaggggtct

SEQ ID NO: 121502 - DNA, 25 bp, mus musculus
ttcattcgagatctggatgactttc

SEQ ID NO: 121503 - DNA, 25 bp, mus musculus
agattctacatggtccaccttaacg

SEQ ID NO: 121504 - DNA, 25 bp, mus musculus
tacatggtccaccttaacgatctgg

SEQ ID NO: 121505 - DNA, 25 bp, mus musculus
gtgctaacctctagaccacctcagc

SEQ ID NO: 121506 - DNA, 25 bp, mus musculus
aacagcaggcagagcacctaaagtc

SEQ ID NO: 121507 - DNA, 25 bp, mus musculus
gcggccacgcgatgaccgtgcaagt

SEQ ID NO: 121508 - DNA, 25 bp, mus musculus
cggccacgcgatgaccgtgcaagtg

SEQ ID NO: 121509 - DNA, 25 bp, mus musculus
ccagcagcagctacaacatacgtag

SEQ ID NO: 121510 - DNA, 25 bp, mus musculus
cagcagcagctacaacatacgtagg

SEQ ID NO: 121511 - DNA, 25 bp, mus musculus
gcagcagctacaacatacgtaggtc

SEQ ID NO: 121512 - DNA, 25 bp, mus musculus
cagcagctacaacatacgtaggtca

SEQ ID NO: 121513 - DNA, 25 bp, mus musculus
agcagctacaacatacgtaggtcaa

SEQ ID NO: 121514 - DNA, 25 bp, mus musculus
gcagctacaacatacgtaggtcaat

SEQ ID NO: 121515 - DNA, 25 bp, mus musculus
cagctacaacatacgtaggtcaatc

SEQ ID NO: 121516 - DNA, 25 bp, mus musculus
agctacaacatacgtaggtcaatcc

SEQ ID NO: 121517 - DNA, 25 bp, mus musculus
ctacaacatacgtaggtcaatccgg

SEQ ID NO: 121518 - DNA, 25 bp, mus musculus
atggctgcgcccatctctgtgattc

SEQ ID NO: 121519 - DNA, 25 bp, mus musculus
gccacgcgatgaccgtgcaagtgga

SEQ ID NO: 121520 - DNA, 25 bp, mus musculus
ccacgcgatgaccgtgcaagtggat

SEQ ID NO: 121521 - DNA, 25 bp, mus musculus
cacgcgatgaccgtgcaagtggatc

SEQ ID NO: 121522 - DNA, 25 bp, mus musculus
acgcgatgaccgtgcaagtggatcc

SEQ ID NO: 121523 - DNA, 25 bp, mus musculus
cgcgatgaccgtgcaagtggatcca

SEQ ID NO: 121524 - DNA, 25 bp, mus musculus
gcgatgaccgtgcaagtggatccag

SEQ ID NO: 121525 - DNA, 25 bp, mus musculus
gaccgtgcaagtggatccagtgctt

SEQ ID NO: 121526 - DNA, 25 bp, mus musculus
gccagcagcagctacaacatacgta

SEQ ID NO: 121527 - DNA, 25 bp, mus musculus
gctaactcggatccattagccaagg

SEQ ID NO: 121528 - DNA, 25 bp, mus musculus
aactcggatccattagccaaggaca

SEQ ID NO: 121529 - DNA, 25 bp, mus musculus
ttgttttcttggcatgggaggcttt

SEQ ID NO: 121530 - DNA, 25 bp, mus musculus
tgttttcttggcatgggaggctttt

SEQ ID NO: 121531 - DNA, 25 bp, mus musculus
ttcttggcatgggaggcttttccct

SEQ ID NO: 121532 - DNA, 25 bp, mus musculus
tcttggcatgggaggcttttcccta

SEQ ID NO: 121533 - DNA, 25 bp, mus musculus
tgcccctagagccacagctgacctg

SEQ ID NO: 121534 - DNA, 25 bp, mus musculus
cccctagagccacagctgacctgtg

SEQ ID NO: 121535 - DNA, 25 bp, mus musculus
ccctagagccacagctgacctgtgt

SEQ ID NO: 121536 - DNA, 25 bp, mus musculus
cctagagccacagctgacctgtgtg

SEQ ID NO: 121537 - DNA, 25 bp, mus musculus
gagccacagctgacctgtgtggaaa

SEQ ID NO: 121538 - DNA, 25 bp, mus musculus
gccacagctgacctgtgtggaaaca

SEQ ID NO: 121539 - DNA, 25 bp, mus musculus
actcggatccattagccaaggacag

SEQ ID NO: 121540 - DNA, 25 bp, mus musculus
ctcggatccattagccaaggacagg

SEQ ID NO: 121541 - DNA, 25 bp, mus musculus
cggatccattagccaaggacaggat

SEQ ID NO: 121542 - DNA, 25 bp, mus musculus
tccattagccaaggacaggatctct

SEQ ID NO: 121543 - DNA, 25 bp, mus musculus
ccattagccaaggacaggatctctt

SEQ ID NO: 121544 - DNA, 25 bp, mus musculus
ggacaggatctcttttcctgaccct

SEQ ID NO: 121545 - DNA, 25 bp, mus musculus
gacaggatctcttttcctgaccctc

SEQ ID NO: 121546 - DNA, 25 bp, mus musculus
ccttgttttcttggcatgggaggct

SEQ ID NO: 121547 - DNA, 25 bp, mus musculus
aagctctgcatcctgcttcacgcct

SEQ ID NO: 121548 - DNA, 25 bp, mus musculus
acccgcgtcgtgaccatcaacaggg

SEQ ID NO: 121549 - DNA, 25 bp, mus musculus
tctgttctcccatcacatctcatct

SEQ ID NO: 121550 - DNA, 25 bp, mus musculus
atctccccaaaggtggcacagctac

SEQ ID NO: 121551 - DNA, 25 bp, mus musculus
tccccaaaggtggcacagctacctc

SEQ ID NO: 121552 - DNA, 25 bp, mus musculus
gtggcacagctacctcagcatggtg

SEQ ID NO: 121553 - DNA, 25 bp, mus musculus
cagcatggtgccctccatcgcttct

SEQ ID NO: 121554 - DNA, 25 bp, mus musculus
catcgcttctctcatattcactata

SEQ ID NO: 121555 - DNA, 25 bp, mus musculus
ttctctcatattcactatacaagtt

SEQ ID NO: 121556 - DNA, 25 bp, mus musculus
catattcactatacaagttgtttgt

SEQ ID NO: 121557 - DNA, 25 bp, mus musculus
ttatgaaaacactcagtcacccctt

SEQ ID NO: 121558 - DNA, 25 bp, mus musculus
tgaaaacactcagtcaccccttatt

SEQ ID NO: 121559 - DNA, 25 bp, mus musculus
accatcaacagggtgatgggctatc

SEQ ID NO: 121560 - DNA, 25 bp, mus musculus
atgggctatctgagctccgcctgaa

SEQ ID NO: 121561 - DNA, 25 bp, mus musculus
ggctatctgagctccgcctgaaagc

SEQ ID NO: 121562 - DNA, 25 bp, mus musculus
tgaaagctcaaggccctctgccaca

SEQ ID NO: 121563 - DNA, 25 bp, mus musculus
ctcctcacacagataggaaacaaag

SEQ ID NO: 121564 - DNA, 25 bp, mus musculus
tggtcttggcctggtgggcttaagc

SEQ ID NO: 121565 - DNA, 25 bp, mus musculus
gggcttaagctccttcaggaatctg

SEQ ID NO: 121566 - DNA, 25 bp, mus musculus
aagctccttcaggaatctgttctcc

SEQ ID NO: 121567 - DNA, 25 bp, mus musculus
agctttcgtgcccttcgcgatagcg

SEQ ID NO: 121568 - DNA, 25 bp, mus musculus
tttcgtgcccttcgcgatagcgggc

SEQ ID NO: 121569 - DNA, 25 bp, mus musculus
atctttcaagatggacctcatctta

SEQ ID NO: 121570 - DNA, 25 bp, mus musculus
caagatggacctcatcttagatgta

SEQ ID NO: 121571 - DNA, 25 bp, mus musculus
ggacctcatcttagatgtaaacatt

SEQ ID NO: 121572 - DNA, 25 bp, mus musculus
tgacaagttccggttggttatagct

SEQ ID NO: 121573 - DNA, 25 bp, mus musculus
tggtaccttggatgatggtgaatac

SEQ ID NO: 121574 - DNA, 25 bp, mus musculus
tgaatacaaccccacagatgacagg

SEQ ID NO: 121575 - DNA, 25 bp, mus musculus
atacaaccccacagatgacaggcct

SEQ ID NO: 121576 - DNA, 25 bp, mus musculus
cacagatgacaggccttccagggct

SEQ ID NO: 121577 - DNA, 25 bp, mus musculus
agatgacaggccttccagggctgac

SEQ ID NO: 121578 - DNA, 25 bp, mus musculus
tgacaggccttccagggctgaccag

SEQ ID NO: 121579 - DNA, 25 bp, mus musculus
gcccttcgcgatagcgggcatcctg

SEQ ID NO: 121580 - DNA, 25 bp, mus musculus
cttcgcgatagcgggcatcctgttc

SEQ ID NO: 121581 - DNA, 25 bp, mus musculus
cgcgatagcgggcatcctgttcgag

SEQ ID NO: 121582 - DNA, 25 bp, mus musculus
gggcatcctgttcgaggatattttc

SEQ ID NO: 121583 - DNA, 25 bp, mus musculus
catcctgttcgaggatattttcgat

SEQ ID NO: 121584 - DNA, 25 bp, mus musculus
agacatcgacccagaaggcaagaaa

SEQ ID NO: 121585 - DNA, 25 bp, mus musculus
catcgacccagaaggcaagaaattt

SEQ ID NO: 121586 - DNA, 25 bp, mus musculus
atcccggctgcactgtgagagtgaa

SEQ ID NO: 121587 - DNA, 25 bp, mus musculus
atatgttctgtggacctggagtcaa

SEQ ID NO: 121588 - DNA, 25 bp, mus musculus
tctgtggacctggagtcaatggaca

SEQ ID NO: 121589 - DNA, 25 bp, mus musculus
cctatctcttggcctcactcactgg

SEQ ID NO: 121590 - DNA, 25 bp, mus musculus
cctcactcactggatggcagccaca

SEQ ID NO: 121591 - DNA, 25 bp, mus musculus
tcactggatggcagccacatgtctt

SEQ ID NO: 121592 - DNA, 25 bp, mus musculus
gatggcagccacatgtcttcaaatt

SEQ ID NO: 121593 - DNA, 25 bp, mus musculus
ttgatttcaaccctaagcaggcaga

SEQ ID NO: 121594 - DNA, 25 bp, mus musculus
tcaaccctaagcaggcagatcaagt

SEQ ID NO: 121595 - DNA, 25 bp, mus musculus
tgttccttggtctatgttcactgca

SEQ ID NO: 121596 - DNA, 25 bp, mus musculus
ttggtctatgttcactgcagcaaag

SEQ ID NO: 121597 - DNA, 25 bp, mus musculus
tcaacactttctaaagtgactgctc

SEQ ID NO: 121598 - DNA, 25 bp, mus musculus
ctttctaaagtgactgctctagaga

SEQ ID NO: 121599 - DNA, 25 bp, mus musculus
attgcatcatttctccacctatttg

SEQ ID NO: 121600 - DNA, 25 bp, mus musculus
tcatttctccacctatttgtgctct

SEQ ID NO: 121601 - DNA, 25 bp, mus musculus
ctccacctatttgtgctctgtcagg

SEQ ID NO: 121602 - DNA, 25 bp, mus musculus
ctatttgtgctctgtcaggcactcc

SEQ ID NO: 121603 - DNA, 25 bp, mus musculus
tgtcaggcactccatgatccatcgt

SEQ ID NO: 121604 - DNA, 25 bp, mus musculus
gcactccatgatccatcgttttacg

SEQ ID NO: 121605 - DNA, 25 bp, mus musculus
gacctggatctggtctgtcctatct

SEQ ID NO: 121606 - DNA, 25 bp, mus musculus
gtctgtcctatctcttggcctcact

SEQ ID NO: 121607 - DNA, 25 bp, mus musculus
gcattccacttggccttatgctgtt

SEQ ID NO: 121608 - DNA, 25 bp, mus musculus
cacttggccttatgctgttgaaata

SEQ ID NO: 121609 - DNA, 25 bp, mus musculus
ttagcttttgtgacaaccaataaga

SEQ ID NO: 121610 - DNA, 25 bp, mus musculus
atattctgacacaagcagtgttaca

SEQ ID NO: 121611 - DNA, 25 bp, mus musculus
ttagcactagtttcaacaccaagaa

SEQ ID NO: 121612 - DNA, 25 bp, mus musculus
tatgcttttaattccagcactcagg

SEQ ID NO: 121613 - DNA, 25 bp, mus musculus
tttaattccagcactcaggagacca

SEQ ID NO: 121614 - DNA, 25 bp, mus musculus
ggcagatctctgtgagtttgaggac

SEQ ID NO: 121615 - DNA, 25 bp, mus musculus
cagcctggtgtacagagggagttcc

SEQ ID NO: 121616 - DNA, 25 bp, mus musculus
gagttccagcacagccagtgccaca

SEQ ID NO: 121617 - DNA, 25 bp, mus musculus
cagcacagccagtgccacacagaaa

SEQ ID NO: 121618 - DNA, 25 bp, mus musculus
tgccacacagaaattctgtctcaaa

SEQ ID NO: 121619 - DNA, 25 bp, mus musculus
tttctgcatttcacatttgtatacc

SEQ ID NO: 121620 - DNA, 25 bp, mus musculus
catttcacatttgtataccaagatg

SEQ ID NO: 121621 - DNA, 25 bp, mus musculus
gctcgtggcctgatccactgggacc

SEQ ID NO: 121622 - DNA, 25 bp, mus musculus
atccactgggaccaggccctattat

SEQ ID NO: 121623 - DNA, 25 bp, mus musculus
tgggaccaggccctattatgcaaat

SEQ ID NO: 121624 - DNA, 25 bp, mus musculus
gcttgttatcttcttcaacagctct

SEQ ID NO: 121625 - DNA, 25 bp, mus musculus
cttcaacagctcttcaatcagggct

SEQ ID NO: 121626 - DNA, 25 bp, mus musculus
cagctcttcaatcagggctgcgtag

SEQ ID NO: 121627 - DNA, 25 bp, mus musculus
gtcgcatctgagaagtccttgtctc

SEQ ID NO: 121628 - DNA, 25 bp, mus musculus
tccttgtctcctgcctctgtgttgg

SEQ ID NO: 121629 - DNA, 25 bp, mus musculus
tgcagttgccctggtgtaggcataa

SEQ ID NO: 121630 - DNA, 25 bp, mus musculus
tgccctggtgtaggcataatacagt

SEQ ID NO: 121631 - DNA, 25 bp, mus musculus
atacagtgtcagttcttagtggagt

SEQ ID NO: 121632 - DNA, 25 bp, mus musculus
cagttcttagtggagtctggggtgt

SEQ ID NO: 121633 - DNA, 25 bp, mus musculus
aagacagcttcaaagcacaggacag

SEQ ID NO: 121634 - DNA, 25 bp, mus musculus
gcttcaaagcacaggacagctgaca

SEQ ID NO: 121635 - DNA, 25 bp, mus musculus
tcaaagcacaggacagctgacagtg

SEQ ID NO: 121636 - DNA, 25 bp, mus musculus
aagcacaggacagctgacagtgtgt

SEQ ID NO: 121637 - DNA, 25 bp, mus musculus
acagctgacagtgtgtccttcacgg

SEQ ID NO: 121638 - DNA, 25 bp, mus musculus
ttcacgggctcagtgaccatcccac

SEQ ID NO: 121639 - DNA, 25 bp, mus musculus
gcctctgtgttggtcccttttcctg

SEQ ID NO: 121640 - DNA, 25 bp, mus musculus
caccctagctgacagtgtgtccttc

SEQ ID NO: 121641 - DNA, 25 bp, mus musculus
gtcccttttcctgggaccagatctg

SEQ ID NO: 121642 - DNA, 25 bp, mus musculus
tttcctgggaccagatctgcctgct

SEQ ID NO: 121643 - DNA, 25 bp, mus musculus
gggaccagatctgcctgcttgtgga

SEQ ID NO: 121644 - DNA, 25 bp, mus musculus
agatctgcctgcttgtggaataagt

SEQ ID NO: 121645 - DNA, 25 bp, mus musculus
tctgcctgcttgtggaataagtgaa

SEQ ID NO: 121646 - DNA, 25 bp, mus musculus
tgaacttgcagttgccctggtgtag

SEQ ID NO: 121647 - DNA, 25 bp, mus musculus
acttgcagttgccctggtgtaggca

SEQ ID NO: 121648 - DNA, 25 bp, mus musculus
agcagtgctgacatagccctggata

SEQ ID NO: 121649 - DNA, 25 bp, mus musculus
gtgctgacatagccctggatatcga

SEQ ID NO: 121650 - DNA, 25 bp, mus musculus
gtcacgctggagtctcatgaaacac

SEQ ID NO: 121651 - DNA, 25 bp, mus musculus
cacgctggagtctcatgaaacacga

SEQ ID NO: 121652 - DNA, 25 bp, mus musculus
tctcatgaaacacgacacaattcta

SEQ ID NO: 121653 - DNA, 25 bp, mus musculus
atgaaacacgacacaattctatcac

SEQ ID NO: 121654 - DNA, 25 bp, mus musculus
gaaacacgacacaattctatcacgg

SEQ ID NO: 121655 - DNA, 25 bp, mus musculus
aacacgacacaattctatcacgggg

SEQ ID NO: 121656 - DNA, 25 bp, mus musculus
acacaattctatcacggggaatgtg

SEQ ID NO: 121657 - DNA, 25 bp, mus musculus
acaattctatcacggggaatgtgac

SEQ ID NO: 121658 - DNA, 25 bp, mus musculus
aattctatcacggggaatgtgacat

SEQ ID NO: 121659 - DNA, 25 bp, mus musculus
ttctatcacggggaatgtgacattt

SEQ ID NO: 121660 - DNA, 25 bp, mus musculus
gctgacatagccctggatatcgaga

SEQ ID NO: 121661 - DNA, 25 bp, mus musculus
ccctcttcaagacttcctccaatgg

SEQ ID NO: 121662 - DNA, 25 bp, mus musculus
ctcttcaagacttcctccaatggca

SEQ ID NO: 121663 - DNA, 25 bp, mus musculus
cttcaagacttcctccaatggcata

SEQ ID NO: 121664 - DNA, 25 bp, mus musculus
aagacttcctccaatggcataggag

SEQ ID NO: 121665 - DNA, 25 bp, mus musculus
tcctccaatggcataggagtcacgc

SEQ ID NO: 121666 - DNA, 25 bp, mus musculus
aggagtcacgctggagtctcatgaa

SEQ ID NO: 121667 - DNA, 25 bp, mus musculus
gagtcacgctggagtctcatgaaac

SEQ ID NO: 121668 - DNA, 25 bp, mus musculus
gaggagtcccagcgcatcaacgcca

SEQ ID NO: 121669 - DNA, 25 bp, mus musculus
ggagtcccagcgcatcaacgccaac

SEQ ID NO: 121670 - DNA, 25 bp, mus musculus
agctgcagcgcgactgagatgaggc

SEQ ID NO: 121671 - DNA, 25 bp, mus musculus
ctgcagcgcgactgagatgaggcca

SEQ ID NO: 121672 - DNA, 25 bp, mus musculus
gcagcgcgactgagatgaggccaca

SEQ ID NO: 121673 - DNA, 25 bp, mus musculus
gaggtgaacgccctcaagagcaaac

SEQ ID NO: 121674 - DNA, 25 bp, mus musculus
tgaacgccctcaagagcaaactcag

SEQ ID NO: 121675 - DNA, 25 bp, mus musculus
aacgccctcaagagcaaactcagga

SEQ ID NO: 121676 - DNA, 25 bp, mus musculus
cgccctcaagagcaaactcaggaga

SEQ ID NO: 121677 - DNA, 25 bp, mus musculus
ccctcaagagcaaactcaggagagg

SEQ ID NO: 121678 - DNA, 25 bp, mus musculus
cgaggcttcatttgttccttccaga

SEQ ID NO: 121679 - DNA, 25 bp, mus musculus
aggcttcatttgttccttccagaag

SEQ ID NO: 121680 - DNA, 25 bp, mus musculus
cgcatcaacgccaaccgcatgaagc

SEQ ID NO: 121681 - DNA, 25 bp, mus musculus
ggcttcatttgttccttccagaagg

SEQ ID NO: 121682 - DNA, 25 bp, mus musculus
catcaacgccaaccgcatgaagctg

SEQ ID NO: 121683 - DNA, 25 bp, mus musculus
tcaacgccaaccgcatgaagctgca

SEQ ID NO: 121684 - DNA, 25 bp, mus musculus
ccaaccgcatgaagctgcagcgcga

SEQ ID NO: 121685 - DNA, 25 bp, mus musculus
aaccgcatgaagctgcagcgcgact

SEQ ID NO: 121686 - DNA, 25 bp, mus musculus
ccgcatgaagctgcagcgcgactga

SEQ ID NO: 121687 - DNA, 25 bp, mus musculus
gcatgaagctgcagcgcgactgaga

SEQ ID NO: 121688 - DNA, 25 bp, mus musculus
atgaagctgcagcgcgactgagatg

SEQ ID NO: 121689 - DNA, 25 bp, mus musculus
ggcctagaaactcacagatggcctg

SEQ ID NO: 121690 - DNA, 25 bp, mus musculus
gaaactcacagatggcctggcagtg

SEQ ID NO: 121691 - DNA, 25 bp, mus musculus
cactgccagttacccacatatgacc

SEQ ID NO: 121692 - DNA, 25 bp, mus musculus
cagttacccacatatgaccagaagc

SEQ ID NO: 121693 - DNA, 25 bp, mus musculus
tatgaccagaagccagggctcctgg

SEQ ID NO: 121694 - DNA, 25 bp, mus musculus
cagaagccagggctcctgggatgtg

SEQ ID NO: 121695 - DNA, 25 bp, mus musculus
ccagggctcctgggatgtggaagat

SEQ ID NO: 121696 - DNA, 25 bp, mus musculus
cccagcgggcacgataactggcagt

SEQ ID NO: 121697 - DNA, 25 bp, mus musculus
gataactggcagtcaaggcgatacc

SEQ ID NO: 121698 - DNA, 25 bp, mus musculus
tcaaggcgatacctcgagggaactg

SEQ ID NO: 121699 - DNA, 25 bp, mus musculus
aacacctagtctgtttgcaaggagg

SEQ ID NO: 121700 - DNA, 25 bp, mus musculus
tagtctgtttgcaaggaggacagga

SEQ ID NO: 121701 - DNA, 25 bp, mus musculus
cacagatggcctggcagtggcatgg

SEQ ID NO: 121702 - DNA, 25 bp, mus musculus
acaggtattgccccacagaggccat

SEQ ID NO: 121703 - DNA, 25 bp, mus musculus
attgccccacagaggccattcattg

SEQ ID NO: 121704 - DNA, 25 bp, mus musculus
ttcattgaacagccaggactgggac

SEQ ID NO: 121705 - DNA, 25 bp, mus musculus
cctgctgtcctccgctcagttgtag

SEQ ID NO: 121706 - DNA, 25 bp, mus musculus
gacacaaacttgattgcccaaagtc

SEQ ID NO: 121707 - DNA, 25 bp, mus musculus
attgcccaaagtcactgccagttac

SEQ ID NO: 121708 - DNA, 25 bp, mus musculus
caaagtcactgccagttacccacat

SEQ ID NO: 121709 - DNA, 25 bp, mus musculus
cgtctacatcagctcactcacatcg

SEQ ID NO: 121710 - DNA, 25 bp, mus musculus
tctacatcagctcactcacatcgca

SEQ ID NO: 121711 - DNA, 25 bp, mus musculus
ctgatttcgacagaatctcgccaac

SEQ ID NO: 121712 - DNA, 25 bp, mus musculus
gatttcgacagaatctcgccaacgg

SEQ ID NO: 121713 - DNA, 25 bp, mus musculus
tcgacagaatctcgccaacggcgtt

SEQ ID NO: 121714 - DNA, 25 bp, mus musculus
gacagaatctcgccaacggcgttcg

SEQ ID NO: 121715 - DNA, 25 bp, mus musculus
gaatctcgccaacggcgttcgtaca

SEQ ID NO: 121716 - DNA, 25 bp, mus musculus
atctcgccaacggcgttcgtacact

SEQ ID NO: 121717 - DNA, 25 bp, mus musculus
ctattcgagagtcgccattaggcga

SEQ ID NO: 121718 - DNA, 25 bp, mus musculus
attcgagagtcgccattaggcgaga

SEQ ID NO: 121719 - DNA, 25 bp, mus musculus
gagtcgccattaggcgagaacgagc

SEQ ID NO: 121720 - DNA, 25 bp, mus musculus
cgccattaggcgagaacgagcagac

SEQ ID NO: 121721 - DNA, 25 bp, mus musculus
cacatcgcacttcctgacgagaagt

SEQ ID NO: 121722 - DNA, 25 bp, mus musculus
ctaacatgactaatcggcttctctg

SEQ ID NO: 121723 - DNA, 25 bp, mus musculus
catgactaatcggcttctctggagc

SEQ ID NO: 121724 - DNA, 25 bp, mus musculus
tgactaatcggcttctctggagctg

SEQ ID NO: 121725 - DNA, 25 bp, mus musculus
taatcggcttctctggagctgattt

SEQ ID NO: 121726 - DNA, 25 bp, mus musculus
atcggcttctctggagctgatttcg

SEQ ID NO: 121727 - DNA, 25 bp, mus musculus
gcttctctggagctgatttcgacag

SEQ ID NO: 121728 - DNA, 25 bp, mus musculus
ttctctggagctgatttcgacagaa

SEQ ID NO: 121729 - DNA, 25 bp, mus musculus
agcatctcttgataaacttaattgt

SEQ ID NO: 121730 - DNA, 25 bp, mus musculus
taaacttaattgtctctcgtcactg

SEQ ID NO: 121731 - DNA, 25 bp, mus musculus
aactctagtgttctcatggagctgc

SEQ ID NO: 121732 - DNA, 25 bp, mus musculus
agtgttctcatggagctgcagagac

SEQ ID NO: 121733 - DNA, 25 bp, mus musculus
tgcctggattcatcgataagctgca

SEQ ID NO: 121734 - DNA, 25 bp, mus musculus
aatgagtccaagtccacatcactga

SEQ ID NO: 121735 - DNA, 25 bp, mus musculus
tccaagtccacatcactgaaagact

SEQ ID NO: 121736 - DNA, 25 bp, mus musculus
tccacatcactgaaagacttcctgg

SEQ ID NO: 121737 - DNA, 25 bp, mus musculus
tcactgaaagacttcctggaaagcc

SEQ ID NO: 121738 - DNA, 25 bp, mus musculus
ttcctggaaagcctaaagagcatca

SEQ ID NO: 121739 - DNA, 25 bp, mus musculus
tagtactgagccaccatgctttaac

SEQ ID NO: 121740 - DNA, 25 bp, mus musculus
tgagccaccatgctttaacttatga

SEQ ID NO: 121741 - DNA, 25 bp, mus musculus
taattgtctctcgtcactgacggca

SEQ ID NO: 121742 - DNA, 25 bp, mus musculus
gtcactgacggcacagagctattga

SEQ ID NO: 121743 - DNA, 25 bp, mus musculus
ctgctcttctttctcgaatgtacca

SEQ ID NO: 121744 - DNA, 25 bp, mus musculus
tgtaccaggagccatatccacggat

SEQ ID NO: 121745 - DNA, 25 bp, mus musculus
catatccacggatgcgacaaaaatc

SEQ ID NO: 121746 - DNA, 25 bp, mus musculus
aacaccacagagagtgagctcgtct

SEQ ID NO: 121747 - DNA, 25 bp, mus musculus
ctcgtctgtagggcttccaaggtgc

SEQ ID NO: 121748 - DNA, 25 bp, mus musculus
gcttccaaggtgcttcgcatatttt

SEQ ID NO: 121749 - DNA, 25 bp, mus musculus
cactgctcacgtcatggcacgcact

SEQ ID NO: 121750 - DNA, 25 bp, mus musculus
actgctcacgtcatggcacgcactc

SEQ ID NO: 121751 - DNA, 25 bp, mus musculus
ccgaacgagccgatccacaacgagc

SEQ ID NO: 121752 - DNA, 25 bp, mus musculus
cgaacgagccgatccacaacgagct

SEQ ID NO: 121753 - DNA, 25 bp, mus musculus
gaacgagccgatccacaacgagctc

SEQ ID NO: 121754 - DNA, 25 bp, mus musculus
aacgagccgatccacaacgagctca

SEQ ID NO: 121755 - DNA, 25 bp, mus musculus
acgagccgatccacaacgagctcac

SEQ ID NO: 121756 - DNA, 25 bp, mus musculus
gagccgatccacaacgagctcacca

SEQ ID NO: 121757 - DNA, 25 bp, mus musculus
tgctcacgtcatggcacgcactccg

SEQ ID NO: 121758 - DNA, 25 bp, mus musculus
tcacgtcatggcacgcactccgcat

SEQ ID NO: 121759 - DNA, 25 bp, mus musculus
gaacgagccgaacgagccgatccac

SEQ ID NO: 121760 - DNA, 25 bp, mus musculus
aacgagccgaacgagccgatccaca

SEQ ID NO: 121761 - DNA, 25 bp, mus musculus
acgagccgaacgagccgatccacaa

SEQ ID NO: 121762 - DNA, 25 bp, mus musculus
gagccgaacgagccgatccacaacg

SEQ ID NO: 121763 - DNA, 25 bp, mus musculus
agccgaacgagccgatccacaacga

SEQ ID NO: 121764 - DNA, 25 bp, mus musculus
gccgaacgagccgatccacaacgag

SEQ ID NO: 121765 - DNA, 25 bp, mus musculus
ctctcctaacagataagctggagtc

SEQ ID NO: 121766 - DNA, 25 bp, mus musculus
ggaccaagaccatccaattcatctt

SEQ ID NO: 121767 - DNA, 25 bp, mus musculus
ggacattcctcactgtggtcagaaa

SEQ ID NO: 121768 - DNA, 25 bp, mus musculus
aatatatcctgttgtcaggtatctg

SEQ ID NO: 121769 - DNA, 25 bp, mus musculus
tcctgttgtcaggtatctgacttat

SEQ ID NO: 121770 - DNA, 25 bp, mus musculus
gacttatgttgttctctacgaagaa

SEQ ID NO: 121771 - DNA, 25 bp, mus musculus
atgataacctaaaaatctatttgat

SEQ ID NO: 121772 - DNA, 25 bp, mus musculus
tattctgttacctagccagatggtt

SEQ ID NO: 121773 - DNA, 25 bp, mus musculus
gttacctagccagatggtttcttgg

SEQ ID NO: 121774 - DNA, 25 bp, mus musculus
tagccagatggtttcttggaatgta

SEQ ID NO: 121775 - DNA, 25 bp, mus musculus
ataagtttacctcaatgaattgcta

SEQ ID NO: 121776 - DNA, 25 bp, mus musculus
ttacctcaatgaattgctaatttaa

SEQ ID NO: 121777 - DNA, 25 bp, mus musculus
agaccatccaattcatcttgaaatc

SEQ ID NO: 121778 - DNA, 25 bp, mus musculus
tccaattcatcttgaaatcacttga

SEQ ID NO: 121779 - DNA, 25 bp, mus musculus
tcatcttgaaatcacttgaagaatt

SEQ ID NO: 121780 - DNA, 25 bp, mus musculus
ctttgagatctactcggcaaaccta

SEQ ID NO: 121781 - DNA, 25 bp, mus musculus
gatctactcggcaaacctagtgcgt

SEQ ID NO: 121782 - DNA, 25 bp, mus musculus
ctcggcaaacctagtgcgttatgcc

SEQ ID NO: 121783 - DNA, 25 bp, mus musculus
aaacctagtgcgttatgcctaagca

SEQ ID NO: 121784 - DNA, 25 bp, mus musculus
ttatgcctaagcatatcagtttgtg

SEQ ID NO: 121785 - DNA, 25 bp, mus musculus
gaaggttccaatgcctacagctcct

SEQ ID NO: 121786 - DNA, 25 bp, mus musculus
tccaatgcctacagctcctattgtt

SEQ ID NO: 121787 - DNA, 25 bp, mus musculus
ctctacaaatcctgggcaactgggt

SEQ ID NO: 121788 - DNA, 25 bp, mus musculus
tgggcaactgggtctcctaacagtt

SEQ ID NO: 121789 - DNA, 25 bp, mus musculus
tccaatcgtggctactgtgtatctc

SEQ ID NO: 121790 - DNA, 25 bp, mus musculus
cgtggctactgtgtatctctgactt

SEQ ID NO: 121791 - DNA, 25 bp, mus musculus
gacaactgtgatgcccaatactcat

SEQ ID NO: 121792 - DNA, 25 bp, mus musculus
taaattggaccatctatcaaaagca

SEQ ID NO: 121793 - DNA, 25 bp, mus musculus
ggaccatctatcaaaagcaaattag

SEQ ID NO: 121794 - DNA, 25 bp, mus musculus
ttcactgtcctatggtacctgtatc

SEQ ID NO: 121795 - DNA, 25 bp, mus musculus
gtcctatggtacctgtatctccatt

SEQ ID NO: 121796 - DNA, 25 bp, mus musculus
tggtacctgtatctccattattttc

SEQ ID NO: 121797 - DNA, 25 bp, mus musculus
gcctacagctcctattgttactact

SEQ ID NO: 121798 - DNA, 25 bp, mus musculus
agctcctattgttactacttcactg

SEQ ID NO: 121799 - DNA, 25 bp, mus musculus
aattcaggctacctggtgtcagttc

SEQ ID NO: 121800 - DNA, 25 bp, mus musculus
ggctacctggtgtcagttctcagtc

SEQ ID NO: 121801 - DNA, 25 bp, mus musculus
ggcactacagacgccaatgtctgga

SEQ ID NO: 121802 - DNA, 25 bp, mus musculus
actggactccatgatcccaaaagga

SEQ ID NO: 121803 - DNA, 25 bp, mus musculus
gatcccaaaaggaatcgtcgctggc

SEQ ID NO: 121804 - DNA, 25 bp, mus musculus
ctgtttctctacaaatcctgggcaa

SEQ ID NO: 121805 - DNA, 25 bp, mus musculus
gactgctgccgtcagcatatacata

SEQ ID NO: 121806 - DNA, 25 bp, mus musculus
tgctgccgtcagcatatacatataa

SEQ ID NO: 121807 - DNA, 25 bp, mus musculus
ctggagggctcacggtgatggataa

SEQ ID NO: 121808 - DNA, 25 bp, mus musculus
gtataacacataacttcagtaaaga

SEQ ID NO: 121809 - DNA, 25 bp, mus musculus
taacacataacttcagtaaagagca

SEQ ID NO: 121810 - DNA, 25 bp, mus musculus
cacataacttcagtaaagagcatag

SEQ ID NO: 121811 - DNA, 25 bp, mus musculus
tagaaatgcacttattccaaagata

SEQ ID NO: 121812 - DNA, 25 bp, mus musculus
aaatgcacttattccaaagatactg

SEQ ID NO: 121813 - DNA, 25 bp, mus musculus
actgaaccttagtattcagtcgctt

SEQ ID NO: 121814 - DNA, 25 bp, mus musculus
tagtattcagtcgcttttgacactt

SEQ ID NO: 121815 - DNA, 25 bp, mus musculus
tattcagtcgcttttgacacttgtg

SEQ ID NO: 121816 - DNA, 25 bp, mus musculus
tcagtcgcttttgacacttgtgtat

SEQ ID NO: 121817 - DNA, 25 bp, mus musculus
tgcaatcatgtcaactgcaatgctt

SEQ ID NO: 121818 - DNA, 25 bp, mus musculus
aatcatgtcaactgcaatgctttta

SEQ ID NO: 121819 - DNA, 25 bp, mus musculus
catgtcaactgcaatgcttttaaaa

SEQ ID NO: 121820 - DNA, 25 bp, mus musculus
attcagagtcaccactgttttctta

SEQ ID NO: 121821 - DNA, 25 bp, mus musculus
cagagtcaccactgttttcttagca

SEQ ID NO: 121822 - DNA, 25 bp, mus musculus
gtggaactgtcctgttttagactgg

SEQ ID NO: 121823 - DNA, 25 bp, mus musculus
ctgtcctgttttagactggagatac

SEQ ID NO: 121824 - DNA, 25 bp, mus musculus
atactggagggctcacggtgatgga

SEQ ID NO: 121825 - DNA, 25 bp, mus musculus
aaccctctcttgccatgaacctgtc

SEQ ID NO: 121826 - DNA, 25 bp, mus musculus
ctcttgccatgaacctgtcctattg

SEQ ID NO: 121827 - DNA, 25 bp, mus musculus
cctgctgctattatccattggcttc

SEQ ID NO: 121828 - DNA, 25 bp, mus musculus
gctattatccattggcttctctgtg

SEQ ID NO: 121829 - DNA, 25 bp, mus musculus
atccattggcttctctgtgacattg

SEQ ID NO: 121830 - DNA, 25 bp, mus musculus
tggcttctctgtgacattgtaggag

SEQ ID NO: 121831 - DNA, 25 bp, mus musculus
ctctgtgacattgtaggaggaacta

SEQ ID NO: 121832 - DNA, 25 bp, mus musculus
ggaactatggccaatctacaggagt

SEQ ID NO: 121833 - DNA, 25 bp, mus musculus
atggccaatctacaggagttcaaca

SEQ ID NO: 121834 - DNA, 25 bp, mus musculus
atggagtcctcctatgtgagtcctc

SEQ ID NO: 121835 - DNA, 25 bp, mus musculus
tcctcctatgtgagtcctcctatgt

SEQ ID NO: 121836 - DNA, 25 bp, mus musculus
agtcctcctatgtgtggagacacca

SEQ ID NO: 121837 - DNA, 25 bp, mus musculus
ccatgaacctgtcctattgttgagt

SEQ ID NO: 121838 - DNA, 25 bp, mus musculus
tgtcaaacatcaccactaagtggat

SEQ ID NO: 121839 - DNA, 25 bp, mus musculus
acatcaccactaagtggatggttat

SEQ ID NO: 121840 - DNA, 25 bp, mus musculus
ccattatccaaactgagtcgttttg

SEQ ID NO: 121841 - DNA, 25 bp, mus musculus
gcataccatgaccatgtgtcaaagg

SEQ ID NO: 121842 - DNA, 25 bp, mus musculus
catgaccatgtgtcaaaggaagtgg

SEQ ID NO: 121843 - DNA, 25 bp, mus musculus
gaccatgattttcctgctgctatta

SEQ ID NO: 121844 - DNA, 25 bp, mus musculus
gattttcctgctgctattatccatt

SEQ ID NO: 121845 - DNA, 25 bp, mus musculus
tgactgccaggtcatcacagctcgc

SEQ ID NO: 121846 - DNA, 25 bp, mus musculus
actgccaggtcatcacagctcgctt

SEQ ID NO: 121847 - DNA, 25 bp, mus musculus
gcctggtcattgttctccaaacaca

SEQ ID NO: 121848 - DNA, 25 bp, mus musculus
ctggtcattgttctccaaacacatc

SEQ ID NO: 121849 - DNA, 25 bp, mus musculus
tgcagcccacaagctgtcctcactg

SEQ ID NO: 121850 - DNA, 25 bp, mus musculus
acaagctgtcctcactgcatctctg

SEQ ID NO: 121851 - DNA, 25 bp, mus musculus
aagctgtcctcactgcatctctgtc

SEQ ID NO: 121852 - DNA, 25 bp, mus musculus
tcctcactgcatctctgtcactaca

SEQ ID NO: 121853 - DNA, 25 bp, mus musculus
cactgcatctctgtcactacaggga

SEQ ID NO: 121854 - DNA, 25 bp, mus musculus
ctgcatctctgtcactacagggaag

SEQ ID NO: 121855 - DNA, 25 bp, mus musculus
ctctgtcactacagggaaggctgct

SEQ ID NO: 121856 - DNA, 25 bp, mus musculus
ctgtcactacagggaaggctgctca

SEQ ID NO: 121857 - DNA, 25 bp, mus musculus
aggtcatcacagctcgcttggccca

SEQ ID NO: 121858 - DNA, 25 bp, mus musculus
gtcatcacagctcgcttggcccagc

SEQ ID NO: 121859 - DNA, 25 bp, mus musculus
catcacagctcgcttggcccagcag

SEQ ID NO: 121860 - DNA, 25 bp, mus musculus
agcagctgcggcacgcttcaggtgt

SEQ ID NO: 121861 - DNA, 25 bp, mus musculus
cggcacgcttcaggtgtggtttccg

SEQ ID NO: 121862 - DNA, 25 bp, mus musculus
gcacgcttcaggtgtggtttccggg

SEQ ID NO: 121863 - DNA, 25 bp, mus musculus
gcttcaggtgtggtttccgggcctg

SEQ ID NO: 121864 - DNA, 25 bp, mus musculus
ttccgggcctggtcattgttctcca

SEQ ID NO: 121865 - DNA, 25 bp, mus musculus
tgatccatgataacaaccctaaagt

SEQ ID NO: 121866 - DNA, 25 bp, mus musculus
ccatgataacaaccctaaagttcag

SEQ ID NO: 121867 - DNA, 25 bp, mus musculus
cggacaccttcaccattacaggcca

SEQ ID NO: 121868 - DNA, 25 bp, mus musculus
gacaccttcaccattacaggccatg

SEQ ID NO: 121869 - DNA, 25 bp, mus musculus
caccttcaccattacaggccatgct

SEQ ID NO: 121870 - DNA, 25 bp, mus musculus
ccttcaccattacaggccatgctga

SEQ ID NO: 121871 - DNA, 25 bp, mus musculus
ttcaccattacaggccatgctgaga

SEQ ID NO: 121872 - DNA, 25 bp, mus musculus
caccattacaggccatgctgagaca

SEQ ID NO: 121873 - DNA, 25 bp, mus musculus
ccattacaggccatgctgagacaaa

SEQ ID NO: 121874 - DNA, 25 bp, mus musculus
attacaggccatgctgagacaaagc

SEQ ID NO: 121875 - DNA, 25 bp, mus musculus
tacaggccatgctgagacaaagcag

SEQ ID NO: 121876 - DNA, 25 bp, mus musculus
caggccatgctgagacaaagcagct

SEQ ID NO: 121877 - DNA, 25 bp, mus musculus
gataacaaccctaaagttcaggcat

SEQ ID NO: 121878 - DNA, 25 bp, mus musculus
ctaaagttcaggcatccctggcagc

SEQ ID NO: 121879 - DNA, 25 bp, mus musculus
ttcaggcatccctggcagcggacac

SEQ ID NO: 121880 - DNA, 25 bp, mus musculus
caggcatccctggcagcggacacct

SEQ ID NO: 121881 - DNA, 25 bp, mus musculus
ggcatccctggcagcggacaccttc

SEQ ID NO: 121882 - DNA, 25 bp, mus musculus
cctggcagcggacaccttcaccatt

SEQ ID NO: 121883 - DNA, 25 bp, mus musculus
gcagcggacaccttcaccattacag

SEQ ID NO: 121884 - DNA, 25 bp, mus musculus
agcggacaccttcaccattacaggc

SEQ ID NO: 121885 - DNA, 25 bp, mus musculus
tgtctttcagcatggcatcattacc

SEQ ID NO: 121886 - DNA, 25 bp, mus musculus
ctttcagcatggcatcattaccaga

SEQ ID NO: 121887 - DNA, 25 bp, mus musculus
gagttgatccatcctaacactgaga

SEQ ID NO: 121888 - DNA, 25 bp, mus musculus
atccatcctaacactgagaccccaa

SEQ ID NO: 121889 - DNA, 25 bp, mus musculus
taagaagcacactttacaattacgt

SEQ ID NO: 121890 - DNA, 25 bp, mus musculus
gaagcacactttacaattacgtgag

SEQ ID NO: 121891 - DNA, 25 bp, mus musculus
gcacactttacaattacgtgagatc

SEQ ID NO: 121892 - DNA, 25 bp, mus musculus
attacgtgagatctgcctctaccca

SEQ ID NO: 121893 - DNA, 25 bp, mus musculus
tgagatctgcctctacccatgcaga

SEQ ID NO: 121894 - DNA, 25 bp, mus musculus
ctgcctctacccatgcagaacagtt

SEQ ID NO: 121895 - DNA, 25 bp, mus musculus
ctacccatgcagaacagttagcagt

SEQ ID NO: 121896 - DNA, 25 bp, mus musculus
ctcttcaccttaccagtagacgagt

SEQ ID NO: 121897 - DNA, 25 bp, mus musculus
catcattaccagagactgtggtatt

SEQ ID NO: 121898 - DNA, 25 bp, mus musculus
tcctctacattacagggagaaagag

SEQ ID NO: 121899 - DNA, 25 bp, mus musculus
ggtcacgttcttcttagcagagccc

SEQ ID NO: 121900 - DNA, 25 bp, mus musculus
ccctatatggctgtctgaccccctt

SEQ ID NO: 121901 - DNA, 25 bp, mus musculus
ccttcatcattggtatgcctactga

SEQ ID NO: 121902 - DNA, 25 bp, mus musculus
tcatcattggtatgcctactgatag

SEQ ID NO: 121903 - DNA, 25 bp, mus musculus
ttggtatgcctactgatagagttga

SEQ ID NO: 121904 - DNA, 25 bp, mus musculus
gtatgcctactgatagagttgatcc

SEQ ID NO: 121905 - DNA, 25 bp, mus musculus
gagtcgagactcgcactgggaacct

SEQ ID NO: 121906 - DNA, 25 bp, mus musculus
agactcgcactgggaacctggtgac

SEQ ID NO: 121907 - DNA, 25 bp, mus musculus
tcctgggccttgcaacgagccttca

SEQ ID NO: 121908 - DNA, 25 bp, mus musculus
ttgcaacgagccttcagcctgagca

SEQ ID NO: 121909 - DNA, 25 bp, mus musculus
caacgagccttcagcctgagcagtg

SEQ ID NO: 121910 - DNA, 25 bp, mus musculus
ttcagcctgagcagtgttatggctc

SEQ ID NO: 121911 - DNA, 25 bp, mus musculus
agcctgagcagtgttatggctctct

SEQ ID NO: 121912 - DNA, 25 bp, mus musculus
gttatggctctctgcctggaatgta

SEQ ID NO: 121913 - DNA, 25 bp, mus musculus
gctctctgcctggaatgtactgctt

SEQ ID NO: 121914 - DNA, 25 bp, mus musculus
ctctgcctggaatgtactgcttgga

SEQ ID NO: 121915 - DNA, 25 bp, mus musculus
actgcttggaattgcgcttgcgcct

SEQ ID NO: 121916 - DNA, 25 bp, mus musculus
tgcgcttgcgccttcccttcgtagt

SEQ ID NO: 121917 - DNA, 25 bp, mus musculus
acctggtgacgcaagacgaggcaag

SEQ ID NO: 121918 - DNA, 25 bp, mus musculus
acgaggcaagctcatgcacgtccgg

SEQ ID NO: 121919 - DNA, 25 bp, mus musculus
caagctcatgcacgtccggctacag

SEQ ID NO: 121920 - DNA, 25 bp, mus musculus
ctgacctaggcaacgagaggcttgt

SEQ ID NO: 121921 - DNA, 25 bp, mus musculus
cacctggacatgccctgctcagcag

SEQ ID NO: 121922 - DNA, 25 bp, mus musculus
ccctgctcagcagtgtcatcctggg

SEQ ID NO: 121923 - DNA, 25 bp, mus musculus
gtgtcatcctgggccttgcaacgag

SEQ ID NO: 121924 - DNA, 25 bp, mus musculus
tcatcctgggccttgcaacgagcct

SEQ ID NO: 121925 - DNA, 25 bp, mus musculus
gagctaatgcaactcctaaaatttc

SEQ ID NO: 121926 - DNA, 25 bp, mus musculus
atgcaactcctaaaatttcttatct

SEQ ID NO: 121927 - DNA, 25 bp, mus musculus
tgaaaacctgaatgccaatgatatt

SEQ ID NO: 121928 - DNA, 25 bp, mus musculus
atatcagtcctataaagattatctc

SEQ ID NO: 121929 - DNA, 25 bp, mus musculus
gattatctcttaattctaggaaatg

SEQ ID NO: 121930 - DNA, 25 bp, mus musculus
ttatctcttaattctaggaaatggt

SEQ ID NO: 121931 - DNA, 25 bp, mus musculus
tctttacacattttctatatctaaa

SEQ ID NO: 121932 - DNA, 25 bp, mus musculus
tacacattttctatatctaaattca

SEQ ID NO: 121933 - DNA, 25 bp, mus musculus
cacattttctatatctaaattcatt

SEQ ID NO: 121934 - DNA, 25 bp, mus musculus
aaattcatttgttgtctctataact

SEQ ID NO: 121935 - DNA, 25 bp, mus musculus
taacttctataactgttcaatttgc

SEQ ID NO: 121936 - DNA, 25 bp, mus musculus
ttctataactgttcaatttgcaatt

SEQ ID NO: 121937 - DNA, 25 bp, mus musculus
atttcttatcttttctcacaagcaa

SEQ ID NO: 121938 - DNA, 25 bp, mus musculus
cttatcttttctcacaagcaagggg

SEQ ID NO: 121939 - DNA, 25 bp, mus musculus
tatcttttctcacaagcaaggggga

SEQ ID NO: 121940 - DNA, 25 bp, mus musculus
ttctcacaagcaagggggacatttg

SEQ ID NO: 121941 - DNA, 25 bp, mus musculus
acttccactgaagatgggtggcagc

SEQ ID NO: 121942 - DNA, 25 bp, mus musculus
atgcaggtcatcaatgctagaaagt

SEQ ID NO: 121943 - DNA, 25 bp, mus musculus
gaaccatacttctgaaaacctgaat

SEQ ID NO: 121944 - DNA, 25 bp, mus musculus
tacttctgaaaacctgaatgccaat

SEQ ID NO: 121945 - DNA, 25 bp, mus musculus
tatttgagctcattcaaagtggccc

SEQ ID NO: 121946 - DNA, 25 bp, mus musculus
agctcattcaaagtggcccagtatg

SEQ ID NO: 121947 - DNA, 25 bp, mus musculus
ccattatgagcagcagcaagaagat

SEQ ID NO: 121948 - DNA, 25 bp, mus musculus
aagatctagcccgaaatctgggcaa

SEQ ID NO: 121949 - DNA, 25 bp, mus musculus
gatctagcccgaaatctgggcaaag

SEQ ID NO: 121950 - DNA, 25 bp, mus musculus
taaacaggtcaactacaatgatggc

SEQ ID NO: 121951 - DNA, 25 bp, mus musculus
aactacaatgatggctcccaggagg

SEQ ID NO: 121952 - DNA, 25 bp, mus musculus
ctacaatgatggctcccaggaggac

SEQ ID NO: 121953 - DNA, 25 bp, mus musculus
acaatgatggctcccaggaggaccg

SEQ ID NO: 121954 - DNA, 25 bp, mus musculus
aatgatggctcccaggaggaccgag

SEQ ID NO: 121955 - DNA, 25 bp, mus musculus
atggctcccaggaggaccgagattg

SEQ ID NO: 121956 - DNA, 25 bp, mus musculus
ctcccaggaggaccgagattggcag

SEQ ID NO: 121957 - DNA, 25 bp, mus musculus
ctcattcaaagtggcccagtatgtg

SEQ ID NO: 121958 - DNA, 25 bp, mus musculus
cattcaaagtggcccagtatgtggt

SEQ ID NO: 121959 - DNA, 25 bp, mus musculus
caaagtggcccagtatgtggtacgg

SEQ ID NO: 121960 - DNA, 25 bp, mus musculus
agtgtggatcctgactactgggaga

SEQ ID NO: 121961 - DNA, 25 bp, mus musculus
tcctgactactgggagaaattgctg

SEQ ID NO: 121962 - DNA, 25 bp, mus musculus
aaattgctgcggcaccattatgagc

SEQ ID NO: 121963 - DNA, 25 bp, mus musculus
tgctgcggcaccattatgagcagca

SEQ ID NO: 121964 - DNA, 25 bp, mus musculus
ggcaccattatgagcagcagcaaga

SEQ ID NO: 121965 - DNA, 25 bp, mus musculus
acctggctgagttcactcacgtgga

SEQ ID NO: 121966 - DNA, 25 bp, mus musculus
tggctgagttcactcacgtggaagc

SEQ ID NO: 121967 - DNA, 25 bp, mus musculus
tagtatgagctcaacccgaacttta

SEQ ID NO: 121968 - DNA, 25 bp, mus musculus
cccaagcggcctttccgcaggatga

SEQ ID NO: 121969 - DNA, 25 bp, mus musculus
aagcggcctttccgcaggatgaact

SEQ ID NO: 121970 - DNA, 25 bp, mus musculus
cggcctttccgcaggatgaactact

SEQ ID NO: 121971 - DNA, 25 bp, mus musculus
cctttccgcaggatgaactactcgg

SEQ ID NO: 121972 - DNA, 25 bp, mus musculus
atgaactactcggatgctattgagt

SEQ ID NO: 121973 - DNA, 25 bp, mus musculus
aactactcggatgctattgagtggc

SEQ ID NO: 121974 - DNA, 25 bp, mus musculus
tactcggatgctattgagtggctga

SEQ ID NO: 121975 - DNA, 25 bp, mus musculus
gggactttctacgagtttggagatg

SEQ ID NO: 121976 - DNA, 25 bp, mus musculus
actttctacgagtttggagatgata

SEQ ID NO: 121977 - DNA, 25 bp, mus musculus
agttcactcacgtggaagctgagtg

SEQ ID NO: 121978 - DNA, 25 bp, mus musculus
tcactcacgtggaagctgagtgtcc

SEQ ID NO: 121979 - DNA, 25 bp, mus musculus
aagctgagtgtcctttcctgacctt

SEQ ID NO: 121980 - DNA, 25 bp, mus musculus
acctagtgtgtgatgtggtggacag

SEQ ID NO: 121981 - DNA, 25 bp, mus musculus
acagagtcctgaagtcaccagtggc

SEQ ID NO: 121982 - DNA, 25 bp, mus musculus
tcctgaagtcaccagtggcaagcat

SEQ ID NO: 121983 - DNA, 25 bp, mus musculus
tgaagtcaccagtggcaagcatagt

SEQ ID NO: 121984 - DNA, 25 bp, mus musculus
agtcaccagtggcaagcatagtatg

SEQ ID NO: 121985 - DNA, 25 bp, mus musculus
tgtgggttccctgtcatcagggcaa

SEQ ID NO: 121986 - DNA, 25 bp, mus musculus
tgggttccctgtcatcagggcaagt

SEQ ID NO: 121987 - DNA, 25 bp, mus musculus
ttgaccctacgggatgtggacagct

SEQ ID NO: 121988 - DNA, 25 bp, mus musculus
gaccctacgggatgtggacagctgc

SEQ ID NO: 121989 - DNA, 25 bp, mus musculus
gctcgtcctggccaaggtgaaggct

SEQ ID NO: 121990 - DNA, 25 bp, mus musculus
tcgtcctggccaaggtgaaggctct

SEQ ID NO: 121991 - DNA, 25 bp, mus musculus
gtcctggccaaggtgaaggctctat

SEQ ID NO: 121992 - DNA, 25 bp, mus musculus
aggctctattcctagatgccttggg

SEQ ID NO: 121993 - DNA, 25 bp, mus musculus
gctctattcctagatgccttggggc

SEQ ID NO: 121994 - DNA, 25 bp, mus musculus
ataaggcgtctgcctcgaagacatg

SEQ ID NO: 121995 - DNA, 25 bp, mus musculus
ggcgtctgcctcgaagacatgccgt

SEQ ID NO: 121996 - DNA, 25 bp, mus musculus
gtttcatgcacaggacctctgaacc

SEQ ID NO: 121997 - DNA, 25 bp, mus musculus
ggttccctgtcatcagggcaagtga

SEQ ID NO: 121998 - DNA, 25 bp, mus musculus
ttcatgcacaggacctctgaaccag

SEQ ID NO: 121999 - DNA, 25 bp, mus musculus
ccctgtcatcagggcaagtgaacta

SEQ ID NO: 122000 - DNA, 25 bp, mus musculus
aactatggtgagccagcggtctctg

SEQ ID NO: 122001 - DNA, 25 bp, mus musculus
ctatggtgagccagcggtctctgct

SEQ ID NO: 122002 - DNA, 25 bp, mus musculus
ctctgctgctccttttgctgttgac

SEQ ID NO: 122003 - DNA, 25 bp, mus musculus
ctgctgctccttttgctgttgaccc

SEQ ID NO: 122004 - DNA, 25 bp, mus musculus
tgctccttttgctgttgaccctacg

SEQ ID NO: 122005 - DNA, 25 bp, mus musculus
ttttgctgttgaccctacgggatgt

SEQ ID NO: 122006 - DNA, 25 bp, mus musculus
caacgccgtcatcaccaggatcatc

SEQ ID NO: 122007 - DNA, 25 bp, mus musculus
catcaccaggatcatcaaggaggcg

SEQ ID NO: 122008 - DNA, 25 bp, mus musculus
cacatcctgtgccaataacttcgca

SEQ ID NO: 122009 - DNA, 25 bp, mus musculus
tgccaataacttcgcaatgaaagga

SEQ ID NO: 122010 - DNA, 25 bp, mus musculus
caataacttcgcaatgaaaggaaag

SEQ ID NO: 122011 - DNA, 25 bp, mus musculus
aaagcgcaagactctcaatgccagt

SEQ ID NO: 122012 - DNA, 25 bp, mus musculus
gactctcaatgccagtgacgtgctg

SEQ ID NO: 122013 - DNA, 25 bp, mus musculus
tctcaatgccagtgacgtgctgtca

SEQ ID NO: 122014 - DNA, 25 bp, mus musculus
caatgccagtgacgtgctgtcagcc

SEQ ID NO: 122015 - DNA, 25 bp, mus musculus
cagtgacgtgctgtcagccatggaa

SEQ ID NO: 122016 - DNA, 25 bp, mus musculus
tgacgtgctgtcagccatggaagag

SEQ ID NO: 122017 - DNA, 25 bp, mus musculus
cgtgctgtcagccatggaagagatg

SEQ ID NO: 122018 - DNA, 25 bp, mus musculus
gctcccggacggtgtcaacatctcc

SEQ ID NO: 122019 - DNA, 25 bp, mus musculus
tgtcaacatctccaaggaggcccga

SEQ ID NO: 122020 - DNA, 25 bp, mus musculus
cgccgccagtgtcttcgttttgtat

SEQ ID NO: 122021 - DNA, 25 bp, mus musculus
tgtcttcgttttgtatgccacatcc

SEQ ID NO: 122022 - DNA, 25 bp, mus musculus
cttcgttttgtatgccacatcctgt

SEQ ID NO: 122023 - DNA, 25 bp, mus musculus
cgttttgtatgccacatcctgtgcc

SEQ ID NO: 122024 - DNA, 25 bp, mus musculus
gtatgccacatcctgtgccaataac

SEQ ID NO: 122025 - DNA, 25 bp, mus musculus
tgccacatcctgtgccaataacttc

SEQ ID NO: 122026 - DNA, 25 bp, mus musculus
ttcttccagctcaagagccagaaac

SEQ ID NO: 122027 - DNA, 25 bp, mus musculus
gaagatatcttcggtgcagtctttt

SEQ ID NO: 122028 - DNA, 25 bp, mus musculus
agagaaaaactcaacctcctgactg

SEQ ID NO: 122029 - DNA, 25 bp, mus musculus
aacctcctgactgaagcactttggg

SEQ ID NO: 122030 - DNA, 25 bp, mus musculus
catgccgccgctctaatacttagct

SEQ ID NO: 122031 - DNA, 25 bp, mus musculus
gccgccgctctaatacttagctgca

SEQ ID NO: 122032 - DNA, 25 bp, mus musculus
gccgctctaatacttagctgcacta

SEQ ID NO: 122033 - DNA, 25 bp, mus musculus
cttagctgcactatgtacagatatt

SEQ ID NO: 122034 - DNA, 25 bp, mus musculus
gatacttttgtctactcccaatgat

SEQ ID NO: 122035 - DNA, 25 bp, mus musculus
caatgatggcttgggcctttcctgt

SEQ ID NO: 122036 - DNA, 25 bp, mus musculus
tggcttgggcctttcctgtataatt

SEQ ID NO: 122037 - DNA, 25 bp, mus musculus
cctttcctgtataattccttgatga

SEQ ID NO: 122038 - DNA, 25 bp, mus musculus
aagggcagcgccttggaggagccca

SEQ ID NO: 122039 - DNA, 25 bp, mus musculus
gaggagcccaaagccacgaggctct

SEQ ID NO: 122040 - DNA, 25 bp, mus musculus
aggctctgacagcccagagttccag

SEQ ID NO: 122041 - DNA, 25 bp, mus musculus
gttccagcttctggcactgagtaaa

SEQ ID NO: 122042 - DNA, 25 bp, mus musculus
gcttctggcactgagtaaagataat

SEQ ID NO: 122043 - DNA, 25 bp, mus musculus
gactactaaatctctctcctctcct

SEQ ID NO: 122044 - DNA, 25 bp, mus musculus
tgcctctcactcttccttggagctg

SEQ ID NO: 122045 - DNA, 25 bp, mus musculus
ttccttggagctgagagcagagaaa

SEQ ID NO: 122046 - DNA, 25 bp, mus musculus
gccctacaagtgcccagagtgtggg

SEQ ID NO: 122047 - DNA, 25 bp, mus musculus
agctccaacctgcttcgtcaccaga

SEQ ID NO: 122048 - DNA, 25 bp, mus musculus
agttcacatcttgttattcatgaaa

SEQ ID NO: 122049 - DNA, 25 bp, mus musculus
ttcacatcttgttattcatgaaaga

SEQ ID NO: 122050 - DNA, 25 bp, mus musculus
acatcttgttattcatgaaagaact

SEQ ID NO: 122051 - DNA, 25 bp, mus musculus
cctttccctgagtgtggtcaaggca

SEQ ID NO: 122052 - DNA, 25 bp, mus musculus
ttccctgagtgtggtcaaggcatga

SEQ ID NO: 122053 - DNA, 25 bp, mus musculus
catgaatgacagtgccccctttctt

SEQ ID NO: 122054 - DNA, 25 bp, mus musculus
ctttcttacaaaccacagagtggag

SEQ ID NO: 122055 - DNA, 25 bp, mus musculus
tttcttacaaaccacagagtggaga

SEQ ID NO: 122056 - DNA, 25 bp, mus musculus
tcttacaaaccacagagtggagaag

SEQ ID NO: 122057 - DNA, 25 bp, mus musculus
cttacaaaccacagagtggagaaga

SEQ ID NO: 122058 - DNA, 25 bp, mus musculus
gcttcgtcaccagaggatccacact

SEQ ID NO: 122059 - DNA, 25 bp, mus musculus
agagaggccctatcgctgtagtgaa

SEQ ID NO: 122060 - DNA, 25 bp, mus musculus
ccctatcgctgtagtgaatgtggca

SEQ ID NO: 122061 - DNA, 25 bp, mus musculus
tatcgctgtagtgaatgtggcaaaa

SEQ ID NO: 122062 - DNA, 25 bp, mus musculus
ttctctcggagttcacatcttgtta

SEQ ID NO: 122063 - DNA, 25 bp, mus musculus
tctcggagttcacatcttgttattc

SEQ ID NO: 122064 - DNA, 25 bp, mus musculus
tcggagttcacatcttgttattcat

SEQ ID NO: 122065 - DNA, 25 bp, mus musculus
gagttcacatcttgttattcatgaa

SEQ ID NO: 122066 - DNA, 25 bp, mus musculus
gagtctttactgcttcttctgatat

SEQ ID NO: 122067 - DNA, 25 bp, mus musculus
tcactagcttggctgagcaacctta

SEQ ID NO: 122068 - DNA, 25 bp, mus musculus
cagaagtttccttcttctacagcga

SEQ ID NO: 122069 - DNA, 25 bp, mus musculus
tttccttcttctacagcgaggagaa

SEQ ID NO: 122070 - DNA, 25 bp, mus musculus
tcttctacagcgaggagaacaaggc

SEQ ID NO: 122071 - DNA, 25 bp, mus musculus
acaaggctcctgagagtgaggagct

SEQ ID NO: 122072 - DNA, 25 bp, mus musculus
tggatcgttcctctcactgtcagag

SEQ ID NO: 122073 - DNA, 25 bp, mus musculus
gttcctctcactgtcagagagaaga

SEQ ID NO: 122074 - DNA, 25 bp, mus musculus
cctcactgagcatcaaacggaccta

SEQ ID NO: 122075 - DNA, 25 bp, mus musculus
tgagcatcaaacggacctatgatga

SEQ ID NO: 122076 - DNA, 25 bp, mus musculus
tcaaacggacctatgatgaacacat

SEQ ID NO: 122077 - DNA, 25 bp, mus musculus
tcccctatacccacatgaatggggg

SEQ ID NO: 122078 - DNA, 25 bp, mus musculus
ctgagcaaccttatcaaggcctgtc

SEQ ID NO: 122079 - DNA, 25 bp, mus musculus
atcaaggcctgtctaatgaacaggt

SEQ ID NO: 122080 - DNA, 25 bp, mus musculus
cccctgataactgtccagagagact

SEQ ID NO: 122081 - DNA, 25 bp, mus musculus
acctgatgcgcatgtgctggcagtt

SEQ ID NO: 122082 - DNA, 25 bp, mus musculus
tgcgcatgtgctggcagttcaaccc

SEQ ID NO: 122083 - DNA, 25 bp, mus musculus
ggcagttcaaccccaagatgaggcc

SEQ ID NO: 122084 - DNA, 25 bp, mus musculus
tgaggccaaccttcctggaaatcgt

SEQ ID NO: 122085 - DNA, 25 bp, mus musculus
tcaacctgctcaaggatgacctcca

SEQ ID NO: 122086 - DNA, 25 bp, mus musculus
ctgctcgatcgataggccttggact

SEQ ID NO: 122087 - DNA, 25 bp, mus musculus
taggccttggacttgtctcacacac

SEQ ID NO: 122088 - DNA, 25 bp, mus musculus
tcagagcactacccctcagtgcttt

SEQ ID NO: 122089 - DNA, 25 bp, mus musculus
cactacccctcagtgctttggagtt

SEQ ID NO: 122090 - DNA, 25 bp, mus musculus
cactgcaaaacataactggatcagg

SEQ ID NO: 122091 - DNA, 25 bp, mus musculus
cagagctctgtacagggctgtgcaa

SEQ ID NO: 122092 - DNA, 25 bp, mus musculus
attggctaagactgctcaaagcctg

SEQ ID NO: 122093 - DNA, 25 bp, mus musculus
taagactgctcaaagcctggtgcct

SEQ ID NO: 122094 - DNA, 25 bp, mus musculus
tgctcaaagcctggtgcctatgtgc

SEQ ID NO: 122095 - DNA, 25 bp, mus musculus
aagcctggtgcctatgtgctgagat

SEQ ID NO: 122096 - DNA, 25 bp, mus musculus
cttgtctgtaacactcaggaaacgg

SEQ ID NO: 122097 - DNA, 25 bp, mus musculus
actcaggaaacggtcgacgagctcg

SEQ ID NO: 122098 - DNA, 25 bp, mus musculus
ttgtctcacacactgactgcagtgt

SEQ ID NO: 122099 - DNA, 25 bp, mus musculus
cacacactgactgcagtgtccatcg

SEQ ID NO: 122100 - DNA, 25 bp, mus musculus
ctgactgcagtgtccatcgtggctg

SEQ ID NO: 122101 - DNA, 25 bp, mus musculus
gcagtgtccatcgtggctggttgaa

SEQ ID NO: 122102 - DNA, 25 bp, mus musculus
ttcttcaaactgtggcactggggtc

SEQ ID NO: 122103 - DNA, 25 bp, mus musculus
ccactctgctggctaagtctaagaa

SEQ ID NO: 122104 - DNA, 25 bp, mus musculus
tggacattttcttcttggcatgaga

SEQ ID NO: 122105 - DNA, 25 bp, mus musculus
ttttcttcttggcatgagacgggct

SEQ ID NO: 122106 - DNA, 25 bp, mus musculus
ttctgctgtcacatgttttggtgtg

SEQ ID NO: 122107 - DNA, 25 bp, mus musculus
ctgctgtcacatgttttggtgtgag

SEQ ID NO: 122108 - DNA, 25 bp, mus musculus
tgcatgctccgctaccagaagtgtc

SEQ ID NO: 122109 - DNA, 25 bp, mus musculus
catgctccgctaccagaagtgtctg

SEQ ID NO: 122110 - DNA, 25 bp, mus musculus
tgctccgctaccagaagtgtctgga

SEQ ID NO: 122111 - DNA, 25 bp, mus musculus
ctccgctaccagaagtgtctggatg

SEQ ID NO: 122112 - DNA, 25 bp, mus musculus
aagtgtctggatgctcgctcccaga

SEQ ID NO: 122113 - DNA, 25 bp, mus musculus
ccctgcggagtcagttgcaagacgt

SEQ ID NO: 122114 - DNA, 25 bp, mus musculus
ttgcaagacgtgtagggtggacagt

SEQ ID NO: 122115 - DNA, 25 bp, mus musculus
tgttcagtcgctgtggggttccctc

SEQ ID NO: 122116 - DNA, 25 bp, mus musculus
ttcagtcgctgtggggttccctcaa

SEQ ID NO: 122117 - DNA, 25 bp, mus musculus
caagcccaaacgtctgggatcccag

SEQ ID NO: 122118 - DNA, 25 bp, mus musculus
tgtcacatgttttggtgtgagccca

SEQ ID NO: 122119 - DNA, 25 bp, mus musculus
aacgtctgggatcccagaccccatg

SEQ ID NO: 122120 - DNA, 25 bp, mus musculus
tcacatgttttggtgtgagcccaat

SEQ ID NO: 122121 - DNA, 25 bp, mus musculus
gtgtgagcccaatgctgccagtctc

SEQ ID NO: 122122 - DNA, 25 bp, mus musculus
aatgctgccagtctctcagaggctg

SEQ ID NO: 122123 - DNA, 25 bp, mus musculus
gccagtctctcagaggctgtgcagg

SEQ ID NO: 122124 - DNA, 25 bp, mus musculus
cagtctctcagaggctgtgcaggct

SEQ ID NO: 122125 - DNA, 25 bp, mus musculus
ctctcagaggctgtgcaggctgcat

SEQ ID NO: 122126 - DNA, 25 bp, mus musculus
tgcatgcatgctccgctaccagaag

SEQ ID NO: 122127 - DNA, 25 bp, mus musculus
tattatcacctttccttgtctctcg

SEQ ID NO: 122128 - DNA, 25 bp, mus musculus
gtcccttgagttctctaaccagcac

SEQ ID NO: 122129 - DNA, 25 bp, mus musculus
actatttattgtgctgggttccagc

SEQ ID NO: 122130 - DNA, 25 bp, mus musculus
gctgggttccagcctgggttgcaga

SEQ ID NO: 122131 - DNA, 25 bp, mus musculus
ttccagcctgggttgcagagaccac

SEQ ID NO: 122132 - DNA, 25 bp, mus musculus
ctgttctgctcgccagtccttttgt

SEQ ID NO: 122133 - DNA, 25 bp, mus musculus
tgctcgccagtccttttgttatccg

SEQ ID NO: 122134 - DNA, 25 bp, mus musculus
cttttacccagcttctcataggcgc

SEQ ID NO: 122135 - DNA, 25 bp, mus musculus
ggatcagtatttccttccactgtag

SEQ ID NO: 122136 - DNA, 25 bp, mus musculus
gtatttccttccactgtagctatta

SEQ ID NO: 122137 - DNA, 25 bp, mus musculus
ccttccactgtagctattagtggct

SEQ ID NO: 122138 - DNA, 25 bp, mus musculus
tagtatcttcctctgaggaataaaa

SEQ ID NO: 122139 - DNA, 25 bp, mus musculus
tgagttctctaaccagcacctctgg

SEQ ID NO: 122140 - DNA, 25 bp, mus musculus
ctctaaccagcacctctgggcttca

SEQ ID NO: 122141 - DNA, 25 bp, mus musculus
ccagcacctctgggcttcaaggcct

SEQ ID NO: 122142 - DNA, 25 bp, mus musculus
gctggacccagcagcaaaaccctac

SEQ ID NO: 122143 - DNA, 25 bp, mus musculus
cattctccttgtctctgcctcggag

SEQ ID NO: 122144 - DNA, 25 bp, mus musculus
ccttgtctctgcctcggagccattg

SEQ ID NO: 122145 - DNA, 25 bp, mus musculus
ataatttgcaccgaaatgtggccgc

SEQ ID NO: 122146 - DNA, 25 bp, mus musculus
cagagccacgcgttcggttatgtaa

SEQ ID NO: 122147 - DNA, 25 bp, mus musculus
gtcatctggaaggccctgacccacc

SEQ ID NO: 122148 - DNA, 25 bp, mus musculus
gagaaactcaagtcccaatggaaca

SEQ ID NO: 122149 - DNA, 25 bp, mus musculus
tccgccattatatcaagtctgccag

SEQ ID NO: 122150 - DNA, 25 bp, mus musculus
attatatcaagtctgccagggtttc

SEQ ID NO: 122151 - DNA, 25 bp, mus musculus
acttgtcttccgacctgcacaatct

SEQ ID NO: 122152 - DNA, 25 bp, mus musculus
acctgcacaatcttgccgcagagcc

SEQ ID NO: 122153 - DNA, 25 bp, mus musculus
acaatcttgccgcagagccctaaga

SEQ ID NO: 122154 - DNA, 25 bp, mus musculus
acattttcttgcataaaggaagaca

SEQ ID NO: 122155 - DNA, 25 bp, mus musculus
agcagtctcagtaaaggtggcccca

SEQ ID NO: 122156 - DNA, 25 bp, mus musculus
tatattgttaacatcccatctgttg

SEQ ID NO: 122157 - DNA, 25 bp, mus musculus
atatccaacgtattatttcataatc

SEQ ID NO: 122158 - DNA, 25 bp, mus musculus
ataataaagcttccatccatgctgt

SEQ ID NO: 122159 - DNA, 25 bp, mus musculus
ctcaagtcccaatggaacaatgaca

SEQ ID NO: 122160 - DNA, 25 bp, mus musculus
taataaagcttccatccatgctgtc

SEQ ID NO: 122161 - DNA, 25 bp, mus musculus
ctcttcaagagtgctacgacaacgg

SEQ ID NO: 122162 - DNA, 25 bp, mus musculus
aagagtgctacgacaacggtcatga

SEQ ID NO: 122163 - DNA, 25 bp, mus musculus
gctacgacaacggtcatgaacccca

SEQ ID NO: 122164 - DNA, 25 bp, mus musculus
gtcatgaaccccaagtttgctgaaa

SEQ ID NO: 122165 - DNA, 25 bp, mus musculus
accccagtgctgccaaggatccaaa

SEQ ID NO: 122166 - DNA, 25 bp, mus musculus
gctcggtttctttccgccattatat

SEQ ID NO: 122167 - DNA, 25 bp, mus musculus
tttctttccgccattatatcaagtc

SEQ ID NO: 122168 - DNA, 25 bp, mus musculus
gattttcttcgcacagtatatagtg

SEQ ID NO: 122169 - DNA, 25 bp, mus musculus
ttttcttcgcacagtatatagtgtc

SEQ ID NO: 122170 - DNA, 25 bp, mus musculus
gctaccaccagtgtgcaaccatcca

SEQ ID NO: 122171 - DNA, 25 bp, mus musculus
taccaccagtgtgcaaccatccagc

SEQ ID NO: 122172 - DNA, 25 bp, mus musculus
gtgtgcaaccatccagctggacttt

SEQ ID NO: 122173 - DNA, 25 bp, mus musculus
gcaaccatccagctggactttcagt

SEQ ID NO: 122174 - DNA, 25 bp, mus musculus
ccatccagctggactttcagttgcc

SEQ ID NO: 122175 - DNA, 25 bp, mus musculus
atccagctggactttcagttgccca

SEQ ID NO: 122176 - DNA, 25 bp, mus musculus
ccagctggactttcagttgcccatc

SEQ ID NO: 122177 - DNA, 25 bp, mus musculus
agctggactttcagttgcccatcag

SEQ ID NO: 122178 - DNA, 25 bp, mus musculus
ggactttcagttgcccatcaggttt

SEQ ID NO: 122179 - DNA, 25 bp, mus musculus
tcagttgcccatcaggtttaacctt

SEQ ID NO: 122180 - DNA, 25 bp, mus musculus
ttcttcgcacagtatatagtgtctt

SEQ ID NO: 122181 - DNA, 25 bp, mus musculus
aaattgaatctttctactcgcccag

SEQ ID NO: 122182 - DNA, 25 bp, mus musculus
attgaatctttctactcgcccagaa

SEQ ID NO: 122183 - DNA, 25 bp, mus musculus
tctactcgcccagaaaaattccttg

SEQ ID NO: 122184 - DNA, 25 bp, mus musculus
agccttctatgggccaaagattgac

SEQ ID NO: 122185 - DNA, 25 bp, mus musculus
ccttctatgggccaaagattgacat

SEQ ID NO: 122186 - DNA, 25 bp, mus musculus
tcggtcgctaccaccagtgtgcaac

SEQ ID NO: 122187 - DNA, 25 bp, mus musculus
tcgctaccaccagtgtgcaaccatc

SEQ ID NO: 122188 - DNA, 25 bp, mus musculus
tcttatgcctgatgttcctgtcata

SEQ ID NO: 122189 - DNA, 25 bp, mus musculus
gcctgatgttcctgtcatacagcca

SEQ ID NO: 122190 - DNA, 25 bp, mus musculus
caatactcagccaggctgagagcaa

SEQ ID NO: 122191 - DNA, 25 bp, mus musculus
gcagtggctccctatttctcttcaa

SEQ ID NO: 122192 - DNA, 25 bp, mus musculus
tcttcaagtcatgggccactggagc

SEQ ID NO: 122193 - DNA, 25 bp, mus musculus
ctggagctccaagcactgccaaccg

SEQ ID NO: 122194 - DNA, 25 bp, mus musculus
ctccaagcactgccaaccgtggtta

SEQ ID NO: 122195 - DNA, 25 bp, mus musculus
gcactgccaaccgtggttattgtgt

SEQ ID NO: 122196 - DNA, 25 bp, mus musculus
ccaaccgtggttattgtgtatcgct

SEQ ID NO: 122197 - DNA, 25 bp, mus musculus
gtgaggcacagtactcctttgtctg

SEQ ID NO: 122198 - DNA, 25 bp, mus musculus
tcagagcctaaagtcacctgaagaa

SEQ ID NO: 122199 - DNA, 25 bp, mus musculus
cctaaagtcacctgaagaacagatg

SEQ ID NO: 122200 - DNA, 25 bp, mus musculus
tgtcatacagccaaggccaggtagc

SEQ ID NO: 122201 - DNA, 25 bp, mus musculus
ctgaagaagacttccccttggctga

SEQ ID NO: 122202 - DNA, 25 bp, mus musculus
accttccttctgccaaaatcaactg

SEQ ID NO: 122203 - DNA, 25 bp, mus musculus
cttctgccaaaatcaactgcccaga

SEQ ID NO: 122204 - DNA, 25 bp, mus musculus
tcaactgcccagagggtgccaacgc

SEQ ID NO: 122205 - DNA, 25 bp, mus musculus
gttcctactgttattatctaattga

SEQ ID NO: 122206 - DNA, 25 bp, mus musculus
atgcaggtcacctggtgtcaatact

SEQ ID NO: 122207 - DNA, 25 bp, mus musculus
gtcacctggtgtcaatactcagcca

SEQ ID NO: 122208 - DNA, 25 bp, mus musculus
gcaatttcccagaaatgaaaggtca

SEQ ID NO: 122209 - DNA, 25 bp, mus musculus
agcagatcttaacctccagtagcaa

SEQ ID NO: 122210 - DNA, 25 bp, mus musculus
gcatgagccttcctgccaaggattg

SEQ ID NO: 122211 - DNA, 25 bp, mus musculus
gctgacaaactgctcttgattgttt

SEQ ID NO: 122212 - DNA, 25 bp, mus musculus
aggaactgctttctctccctgactc

SEQ ID NO: 122213 - DNA, 25 bp, mus musculus
cctctgctcatcctagccatacaat

SEQ ID NO: 122214 - DNA, 25 bp, mus musculus
ctcatcctagccatacaattttcca

SEQ ID NO: 122215 - DNA, 25 bp, mus musculus
ttttccagtcagcaaacctcattac

SEQ ID NO: 122216 - DNA, 25 bp, mus musculus
agtcagcaaacctcattactaatca

SEQ ID NO: 122217 - DNA, 25 bp, mus musculus
caaacctcattactaatcatgtagg

SEQ ID NO: 122218 - DNA, 25 bp, mus musculus
tcattactaatcatgtagggaatgg

SEQ ID NO: 122219 - DNA, 25 bp, mus musculus
aaagcagacagagcaccttttgatc

SEQ ID NO: 122220 - DNA, 25 bp, mus musculus
tcttaacctccagtagcaaattgtg

SEQ ID NO: 122221 - DNA, 25 bp, mus musculus
ttcttggcagttgcagggataaagg

SEQ ID NO: 122222 - DNA, 25 bp, mus musculus
gcaacgcactttggggcacaggcag

SEQ ID NO: 122223 - DNA, 25 bp, mus musculus
cactttggggcacaggcaggctttt

SEQ ID NO: 122224 - DNA, 25 bp, mus musculus
ggcttttcctggcaccatgaacctg

SEQ ID NO: 122225 - DNA, 25 bp, mus musculus
caccatgaacctgaggacaaccgga

SEQ ID NO: 122226 - DNA, 25 bp, mus musculus
acagacagtctctcagctctgtact

SEQ ID NO: 122227 - DNA, 25 bp, mus musculus
agtctctcagctctgtactgtgaga

SEQ ID NO: 122228 - DNA, 25 bp, mus musculus
ataagccagaactgtacctgagaaa

SEQ ID NO: 122229 - DNA, 25 bp, mus musculus
aggagtcacctgacccagagttgtc

SEQ ID NO: 122230 - DNA, 25 bp, mus musculus
aacagcagctagattactcacatct

SEQ ID NO: 122231 - DNA, 25 bp, mus musculus
agctagattactcacatctagaaca

SEQ ID NO: 122232 - DNA, 25 bp, mus musculus
tagattactcacatctagaacagga

SEQ ID NO: 122233 - DNA, 25 bp, mus musculus
attactcacatctagaacaggagaa

SEQ ID NO: 122234 - DNA, 25 bp, mus musculus
aggagctctcagaccagccactgga

SEQ ID NO: 122235 - DNA, 25 bp, mus musculus
tctcagaccagccactggatcaagc

SEQ ID NO: 122236 - DNA, 25 bp, mus musculus
cagaccagccactggatcaagcact

SEQ ID NO: 122237 - DNA, 25 bp, mus musculus
accagccactggatcaagcactagt

SEQ ID NO: 122238 - DNA, 25 bp, mus musculus
cactggatcaagcactagtaaagaa

SEQ ID NO: 122239 - DNA, 25 bp, mus musculus
agaaccggacacagcaggagaagta

SEQ ID NO: 122240 - DNA, 25 bp, mus musculus
cagagttgtccctgggaaaacagca

SEQ ID NO: 122241 - DNA, 25 bp, mus musculus
gaaccggacacagcaggagaagtag

SEQ ID NO: 122242 - DNA, 25 bp, mus musculus
agttgtccctgggaaaacagcagca

SEQ ID NO: 122243 - DNA, 25 bp, mus musculus
agccagaattacacctaggaaagca

SEQ ID NO: 122244 - DNA, 25 bp, mus musculus
aattacacctaggaaagcagcagca

SEQ ID NO: 122245 - DNA, 25 bp, mus musculus
gaaagcagcagcagcaacagataga

SEQ ID NO: 122246 - DNA, 25 bp, mus musculus
agcagcagcagcaacagatagagcg

SEQ ID NO: 122247 - DNA, 25 bp, mus musculus
gaccaaaaagcctgggtcagtcact

SEQ ID NO: 122248 - DNA, 25 bp, mus musculus
aaagcctgggtcagtcacttaagca

SEQ ID NO: 122249 - DNA, 25 bp, mus musculus
acatgtacagccattatacagccta

SEQ ID NO: 122250 - DNA, 25 bp, mus musculus
acagccattatacagcctaaagctg

SEQ ID NO: 122251 - DNA, 25 bp, mus musculus
acaattctaatctcttctcttatgt

SEQ ID NO: 122252 - DNA, 25 bp, mus musculus
tttggcactacgcagttgtgtagca

SEQ ID NO: 122253 - DNA, 25 bp, mus musculus
actacgcagttgtgtagcagttgag

SEQ ID NO: 122254 - DNA, 25 bp, mus musculus
ttttctcctgattgctcctgtggta

SEQ ID NO: 122255 - DNA, 25 bp, mus musculus
cctgattgctcctgtggtaaagatg

SEQ ID NO: 122256 - DNA, 25 bp, mus musculus
agtcacccgggccttgcatataaat

SEQ ID NO: 122257 - DNA, 25 bp, mus musculus
cagtgagcacatctagctgatgata

SEQ ID NO: 122258 - DNA, 25 bp, mus musculus
ctagttccctgatcaaaaaatgcaa

SEQ ID NO: 122259 - DNA, 25 bp, mus musculus
taaatctgatcatccttgtgttgtg

SEQ ID NO: 122260 - DNA, 25 bp, mus musculus
tgatcatccttgtgttgtgaacttt

SEQ ID NO: 122261 - DNA, 25 bp, mus musculus
attatacagcctaaagctgtcagca

SEQ ID NO: 122262 - DNA, 25 bp, mus musculus
gatcatccttgtgttgtgaactttt

SEQ ID NO: 122263 - DNA, 25 bp, mus musculus
cagcctaaagctgtcagcagaatga

SEQ ID NO: 122264 - DNA, 25 bp, mus musculus
agaatgactcaacattgccttcact

SEQ ID NO: 122265 - DNA, 25 bp, mus musculus
actcaacattgccttcacttcttaa

SEQ ID NO: 122266 - DNA, 25 bp, mus musculus
gttatttaccttcaggtctatatga

SEQ ID NO: 122267 - DNA, 25 bp, mus musculus
taccttcaggtctatatgataatct

SEQ ID NO: 122268 - DNA, 25 bp, mus musculus
tgtttacccaacacaattctaatct

SEQ ID NO: 122269 - DNA, 25 bp, mus musculus
cccaacacaattctaatctcttctc

SEQ ID NO: 122270 - DNA, 25 bp, mus musculus
cacctgcgggaacgatcgtcggcaa

SEQ ID NO: 122271 - DNA, 25 bp, mus musculus
tgggtctgctgcaggccgagtacac

SEQ ID NO: 122272 - DNA, 25 bp, mus musculus
tagcacacgtggacctgattgagaa

SEQ ID NO: 122273 - DNA, 25 bp, mus musculus
tgaactatgcacccctagagaagtg

SEQ ID NO: 122274 - DNA, 25 bp, mus musculus
actatgcacccctagagaagtgacc

SEQ ID NO: 122275 - DNA, 25 bp, mus musculus
atgcacccctagagaagtgaccgct

SEQ ID NO: 122276 - DNA, 25 bp, mus musculus
agaagtgaccgctggagcctgcact

SEQ ID NO: 122277 - DNA, 25 bp, mus musculus
gtctcctgctggccacgggcagcct

SEQ ID NO: 122278 - DNA, 25 bp, mus musculus
cgggcagcctgtcgtgctatgttca

SEQ ID NO: 122279 - DNA, 25 bp, mus musculus
gcagcctgtcgtgctatgttcaaac

SEQ ID NO: 122280 - DNA, 25 bp, mus musculus
ttcaaactgagctattggggatgtt

SEQ ID NO: 122281 - DNA, 25 bp, mus musculus
aaactgagctattggggatgttggt

SEQ ID NO: 122282 - DNA, 25 bp, mus musculus
atgccctggacgctctgggcctaaa

SEQ ID NO: 122283 - DNA, 25 bp, mus musculus
ccctggacgctctgggcctaaagcg

SEQ ID NO: 122284 - DNA, 25 bp, mus musculus
acgctctgggcctaaagcgctactg

SEQ ID NO: 122285 - DNA, 25 bp, mus musculus
ctctgggcctaaagcgctactgctg

SEQ ID NO: 122286 - DNA, 25 bp, mus musculus
tgggcctaaagcgctactgctgccg

SEQ ID NO: 122287 - DNA, 25 bp, mus musculus
taaagcgctactgctgccgccgcat

SEQ ID NO: 122288 - DNA, 25 bp, mus musculus
tgctgctagcacacgtggacctgat

SEQ ID NO: 122289 - DNA, 25 bp, mus musculus
tgctagcacacgtggacctgattga

SEQ ID NO: 122290 - DNA, 25 bp, mus musculus
agcaaatgcacagatcggagatgac

SEQ ID NO: 122291 - DNA, 25 bp, mus musculus
aaatgcacagatcggagatgactcc

SEQ ID NO: 122292 - DNA, 25 bp, mus musculus
ctggagaaccccagtgtggagacac

SEQ ID NO: 122293 - DNA, 25 bp, mus musculus
gagaaccccagtgtggagacactcc

SEQ ID NO: 122294 - DNA, 25 bp, mus musculus
aaccccagtgtggagacactcccag

SEQ ID NO: 122295 - DNA, 25 bp, mus musculus
gagacactcccagagtcaacgttcg

SEQ ID NO: 122296 - DNA, 25 bp, mus musculus
acactcccagagtcaacgttcgagc

SEQ ID NO: 122297 - DNA, 25 bp, mus musculus
gagtcaacgttcgagcctgtgccca

SEQ ID NO: 122298 - DNA, 25 bp, mus musculus
tcaacgttcgagcctgtgcccattc

SEQ ID NO: 122299 - DNA, 25 bp, mus musculus
acgttcgagcctgtgcccattcagg

SEQ ID NO: 122300 - DNA, 25 bp, mus musculus
cctgtgcccattcaggccaagacct

SEQ ID NO: 122301 - DNA, 25 bp, mus musculus
gagaagaccctgcatgatcaactcg

SEQ ID NO: 122302 - DNA, 25 bp, mus musculus
caggcctgaagcaccatcttctgca

SEQ ID NO: 122303 - DNA, 25 bp, mus musculus
tgaagcaccatcttctgcatcttga

SEQ ID NO: 122304 - DNA, 25 bp, mus musculus
agcaccatcttctgcatcttgacct

SEQ ID NO: 122305 - DNA, 25 bp, mus musculus
ttccatctcctttaccacaacaaga

SEQ ID NO: 122306 - DNA, 25 bp, mus musculus
ctcctttaccacaacaagagcacct

SEQ ID NO: 122307 - DNA, 25 bp, mus musculus
ctttaccacaacaagagcacctgcg

SEQ ID NO: 122308 - DNA, 25 bp, mus musculus
aagagcacctgcgcccagctggaga

SEQ ID NO: 122309 - DNA, 25 bp, mus musculus
cagctggagaaccccagtgtggaga

SEQ ID NO: 122310 - DNA, 25 bp, mus musculus
cctctcctcaaaggcaaggctctac

SEQ ID NO: 122311 - DNA, 25 bp, mus musculus
gagtttcttcaccgctgtcccattt

SEQ ID NO: 122312 - DNA, 25 bp, mus musculus
tactctaattctaaccagagcaagc

SEQ ID NO: 122313 - DNA, 25 bp, mus musculus
tctaattctaaccagagcaagcttt

SEQ ID NO: 122314 - DNA, 25 bp, mus musculus
taagattccttttcctgttcatcag

SEQ ID NO: 122315 - DNA, 25 bp, mus musculus
tccttttcctgttcatcagcagttg

SEQ ID NO: 122316 - DNA, 25 bp, mus musculus
ttttcctgttcatcagcagttgtta

SEQ ID NO: 122317 - DNA, 25 bp, mus musculus
tcctgttcatcagcagttgttatta

SEQ ID NO: 122318 - DNA, 25 bp, mus musculus
gttattacatcccttgtggcacatt

SEQ ID NO: 122319 - DNA, 25 bp, mus musculus
aaacttttatgagctcatgtagcaa

SEQ ID NO: 122320 - DNA, 25 bp, mus musculus
gtagcaatcaaattatcctgtggat

SEQ ID NO: 122321 - DNA, 25 bp, mus musculus
gcaatcaaattatcctgtggattga

SEQ ID NO: 122322 - DNA, 25 bp, mus musculus
cgctgtcccattttaagactgcttg

SEQ ID NO: 122323 - DNA, 25 bp, mus musculus
tgtcccattttaagactgcttgaat

SEQ ID NO: 122324 - DNA, 25 bp, mus musculus
atctttctaatctgctatgcttgaa

SEQ ID NO: 122325 - DNA, 25 bp, mus musculus
tttctaatctgctatgcttgaatgg

SEQ ID NO: 122326 - DNA, 25 bp, mus musculus
atctgctatgcttgaatggcacgcg

SEQ ID NO: 122327 - DNA, 25 bp, mus musculus
tatgcttgaatggcacgcggtacaa

SEQ ID NO: 122328 - DNA, 25 bp, mus musculus
tgaatggcacgcggtacaaaggaaa

SEQ ID NO: 122329 - DNA, 25 bp, mus musculus
attatgcaaattcccagatctgaag

SEQ ID NO: 122330 - DNA, 25 bp, mus musculus
cgatcatctacctagacctcatcac

SEQ ID NO: 122331 - DNA, 25 bp, mus musculus
acctagacctcatcacccatgagga

SEQ ID NO: 122332 - DNA, 25 bp, mus musculus
gcccgatgctcagtagagcagacga

SEQ ID NO: 122333 - DNA, 25 bp, mus musculus
gagcagacgatcccatcgatgactc

SEQ ID NO: 122334 - DNA, 25 bp, mus musculus
atgactcgctcatctgtcgccatgc

SEQ ID NO: 122335 - DNA, 25 bp, mus musculus
acacactagtcacccttgtacagat

SEQ ID NO: 122336 - DNA, 25 bp, mus musculus
tagtcacccttgtacagattgtcgt

SEQ ID NO: 122337 - DNA, 25 bp, mus musculus
cccttgtacagattgtcgtgaatca

SEQ ID NO: 122338 - DNA, 25 bp, mus musculus
tcgtgaatcatcacattatcacaca

SEQ ID NO: 122339 - DNA, 25 bp, mus musculus
tgaatcatcacattatcacacacca

SEQ ID NO: 122340 - DNA, 25 bp, mus musculus
atcacattatcacacaccagcttcg

SEQ ID NO: 122341 - DNA, 25 bp, mus musculus
acattatcacacaccagcttcgaca

SEQ ID NO: 122342 - DNA, 25 bp, mus musculus
tcacccatgaggagccgttccccga

SEQ ID NO: 122343 - DNA, 25 bp, mus musculus
cgttccccgacatctacgatatgcg

SEQ ID NO: 122344 - DNA, 25 bp, mus musculus
acatctacgatatgcgggacatctc

SEQ ID NO: 122345 - DNA, 25 bp, mus musculus
gggacatctcagactggctgtgcct

SEQ ID NO: 122346 - DNA, 25 bp, mus musculus
acatctcagactggctgtgcctgga

SEQ ID NO: 122347 - DNA, 25 bp, mus musculus
gcctggacctgaagagcccgatgct

SEQ ID NO: 122348 - DNA, 25 bp, mus musculus
tggacctgaagagcccgatgctcag

SEQ ID NO: 122349 - DNA, 25 bp, mus musculus
agagcccgatgctcagtagagcaga

SEQ ID NO: 122350 - DNA, 25 bp, mus musculus
ggctggccctgaggggaatagacca

SEQ ID NO: 122351 - DNA, 25 bp, mus musculus
agagcatagcactggccctagagct

SEQ ID NO: 122352 - DNA, 25 bp, mus musculus
ttctctgtggactttgccacatttc

SEQ ID NO: 122353 - DNA, 25 bp, mus musculus
gtggactttgccacatttctgatca

SEQ ID NO: 122354 - DNA, 25 bp, mus musculus
tttgccacatttctgatcagaggtg

SEQ ID NO: 122355 - DNA, 25 bp, mus musculus
gtacactaacatttctccccagtct

SEQ ID NO: 122356 - DNA, 25 bp, mus musculus
ttctccccagtctaggcctttgcat

SEQ ID NO: 122357 - DNA, 25 bp, mus musculus
ccagtctaggcctttgcatttattt

SEQ ID NO: 122358 - DNA, 25 bp, mus musculus
ggcagtcctcagcaggcccagggaa

SEQ ID NO: 122359 - DNA, 25 bp, mus musculus
ccttggcgtgactcttgactatcta

SEQ ID NO: 122360 - DNA, 25 bp, mus musculus
aacgccacctaactgctaaatggtg

SEQ ID NO: 122361 - DNA, 25 bp, mus musculus
tcatgtggtggacctgtgtaaatat

SEQ ID NO: 122362 - DNA, 25 bp, mus musculus
tagcactggccctagagctggctct

SEQ ID NO: 122363 - DNA, 25 bp, mus musculus
tagagctggctctgtactaggagac

SEQ ID NO: 122364 - DNA, 25 bp, mus musculus
tggctctgtactaggagacaattgc

SEQ ID NO: 122365 - DNA, 25 bp, mus musculus
atgagtcctattcccaaagaactgc

SEQ ID NO: 122366 - DNA, 25 bp, mus musculus
cctattcccaaagaactgctgccct

SEQ ID NO: 122367 - DNA, 25 bp, mus musculus
tcccaagccagtgaaatgtgaaggg

SEQ ID NO: 122368 - DNA, 25 bp, mus musculus
gttggctcccttagcctcagaggga

SEQ ID NO: 122369 - DNA, 25 bp, mus musculus
ctccagctgtggggctcaggaaaaa

SEQ ID NO: 122370 - DNA, 25 bp, mus musculus
atgtagctttcattacagcacattt

SEQ ID NO: 122371 - DNA, 25 bp, mus musculus
gatgatccttgttttcaggttctaa

SEQ ID NO: 122372 - DNA, 25 bp, mus musculus
agcaatcccttcaagtcaaaagctc

SEQ ID NO: 122373 - DNA, 25 bp, mus musculus
cccttcaagtcaaaagctctcctcg

SEQ ID NO: 122374 - DNA, 25 bp, mus musculus
ttcaagtcaaaagctctcctcggaa

SEQ ID NO: 122375 - DNA, 25 bp, mus musculus
tcaaaagctctcctcggaatgaaga

SEQ ID NO: 122376 - DNA, 25 bp, mus musculus
aaagctctcctcggaatgaagaatg

SEQ ID NO: 122377 - DNA, 25 bp, mus musculus
aaatgtctttctgttcataatacta

SEQ ID NO: 122378 - DNA, 25 bp, mus musculus
tgtctttctgttcataatactagac

SEQ ID NO: 122379 - DNA, 25 bp, mus musculus
ctttctgttcataatactagacact

SEQ ID NO: 122380 - DNA, 25 bp, mus musculus
gttcataatactagacactgttgga

SEQ ID NO: 122381 - DNA, 25 bp, mus musculus
cataatactagacactgttggaccc

SEQ ID NO: 122382 - DNA, 25 bp, mus musculus
cttgctgatattgtctcttgtaata

SEQ ID NO: 122383 - DNA, 25 bp, mus musculus
atattgagctgagttccttttaaga

SEQ ID NO: 122384 - DNA, 25 bp, mus musculus
tattctactggggtgttttcaagtg

SEQ ID NO: 122385 - DNA, 25 bp, mus musculus
gtgttttcaagtgtcggcttagaat

SEQ ID NO: 122386 - DNA, 25 bp, mus musculus
ttttcaagtgtcggcttagaatttg

SEQ ID NO: 122387 - DNA, 25 bp, mus musculus
agacttccattgtaaatactgtaga

SEQ ID NO: 122388 - DNA, 25 bp, mus musculus
gacatgagcaatcccttcaagtcaa

SEQ ID NO: 122389 - DNA, 25 bp, mus musculus
atgagcaatcccttcaagtcaaaag

SEQ ID NO: 122390 - DNA, 25 bp, mus musculus
accacctatggggtcttgctgctgc

SEQ ID NO: 122391 - DNA, 25 bp, mus musculus
gtcttgctgctgcctgtcatggctt

SEQ ID NO: 122392 - DNA, 25 bp, mus musculus
gcaagcccgctctgatcaacggagg

SEQ ID NO: 122393 - DNA, 25 bp, mus musculus
ccgctctgatcaacggaggactatc

SEQ ID NO: 122394 - DNA, 25 bp, mus musculus
acagaattcactcactcactccggt

SEQ ID NO: 122395 - DNA, 25 bp, mus musculus
cactcactccggtcagaacttacca

SEQ ID NO: 122396 - DNA, 25 bp, mus musculus
cgttgattgccttacgattcagcca

SEQ ID NO: 122397 - DNA, 25 bp, mus musculus
ttgccttacgattcagccaaatggt

SEQ ID NO: 122398 - DNA, 25 bp, mus musculus
tcagccaaatggttctgtaagatac

SEQ ID NO: 122399 - DNA, 25 bp, mus musculus
ttctgtaagatacacctcttcctca

SEQ ID NO: 122400 - DNA, 25 bp, mus musculus
agaagccagctgaacagcctagcta

SEQ ID NO: 122401 - DNA, 25 bp, mus musculus
cagctgaacagcctagctaaaaatg

SEQ ID NO: 122402 - DNA, 25 bp, mus musculus
cctgtcatggctttctttgcagttt

SEQ ID NO: 122403 - DNA, 25 bp, mus musculus
atggctttctttgcagttttgacca

SEQ ID NO: 122404 - DNA, 25 bp, mus musculus
ttgaccatttttatccttctggtca

SEQ ID NO: 122405 - DNA, 25 bp, mus musculus
atttttatccttctggtcatggagg

SEQ ID NO: 122406 - DNA, 25 bp, mus musculus
aaattctacgttggtgcaggcacca

SEQ ID NO: 122407 - DNA, 25 bp, mus musculus
ctgctctcctccaagttcagtaatg

SEQ ID NO: 122408 - DNA, 25 bp, mus musculus
ttgcacgctgcagcaagcccgctct

SEQ ID NO: 122409 - DNA, 25 bp, mus musculus
gctgcagcaagcccgctctgatcaa

SEQ ID NO: 122410 - DNA, 25 bp, mus musculus
catctatgacctttttatggctttc

SEQ ID NO: 122411 - DNA, 25 bp, mus musculus
tgacctttttatggctttcagcact

SEQ ID NO: 122412 - DNA, 25 bp, mus musculus
ctgcccaaaggactcgggttgtctg

SEQ ID NO: 122413 - DNA, 25 bp, mus musculus
aaaggactcgggttgtctgacatcg

SEQ ID NO: 122414 - DNA, 25 bp, mus musculus
gacatcgctgcatgatgcatctcag

SEQ ID NO: 122415 - DNA, 25 bp, mus musculus
gctgcatgatgcatctcagcccgcc

SEQ ID NO: 122416 - DNA, 25 bp, mus musculus
ctcactctgtgcagatcatgcccag

SEQ ID NO: 122417 - DNA, 25 bp, mus musculus
agatcatgcccagtcacttcctcca

SEQ ID NO: 122418 - DNA, 25 bp, mus musculus
tcctccactggatggaggagaacca

SEQ ID NO: 122419 - DNA, 25 bp, mus musculus
aagtcagtggcttcctgctcagcct

SEQ ID NO: 122420 - DNA, 25 bp, mus musculus
gtggcttcctgctcagccttcttgc

SEQ ID NO: 122421 - DNA, 25 bp, mus musculus
tcagccttcttgcttctccctttaa

SEQ ID NO: 122422 - DNA, 25 bp, mus musculus
ttttatggctttcagcactctcaga

SEQ ID NO: 122423 - DNA, 25 bp, mus musculus
taaataaagacacccattgagtgac

SEQ ID NO: 122424 - DNA, 25 bp, mus musculus
ggctttcagcactctcagagttaat

SEQ ID NO: 122425 - DNA, 25 bp, mus musculus
tagagactggcttaggagggcactg

SEQ ID NO: 122426 - DNA, 25 bp, mus musculus
ggcactggtggccctgttaacagcc

SEQ ID NO: 122427 - DNA, 25 bp, mus musculus
ggtggccctgttaacagcctggcat

SEQ ID NO: 122428 - DNA, 25 bp, mus musculus
cacctggtttcaccctttctgctgc

SEQ ID NO: 122429 - DNA, 25 bp, mus musculus
tacctgcaccaccttaactgttgct

SEQ ID NO: 122430 - DNA, 25 bp, mus musculus
tgttgcttttgtatgcccttcgctc

SEQ ID NO: 122431 - DNA, 25 bp, mus musculus
actagatgctagctcgcgatggtag

SEQ ID NO: 122432 - DNA, 25 bp, mus musculus
ctagatgctagctcgcgatggtagt

SEQ ID NO: 122433 - DNA, 25 bp, mus musculus
atcccaaagcaggatccttattgac

SEQ ID NO: 122434 - DNA, 25 bp, mus musculus
atccttattgacgggatatgatgag

SEQ ID NO: 122435 - DNA, 25 bp, mus musculus
atgagttcggccagattccacggag

SEQ ID NO: 122436 - DNA, 25 bp, mus musculus
agttcggccagattccacggaggct

SEQ ID NO: 122437 - DNA, 25 bp, mus musculus
tcggccagattccacggaggctttc

SEQ ID NO: 122438 - DNA, 25 bp, mus musculus
gccagattccacggaggctttcccg

SEQ ID NO: 122439 - DNA, 25 bp, mus musculus
cagagcagcaacagccccttaaaaa

SEQ ID NO: 122440 - DNA, 25 bp, mus musculus
agagcagcaacagccccttaaaaag

SEQ ID NO: 122441 - DNA, 25 bp, mus musculus
agcagcaacagccccttaaaaagag

SEQ ID NO: 122442 - DNA, 25 bp, mus musculus
gcagcaacagccccttaaaaagaga

SEQ ID NO: 122443 - DNA, 25 bp, mus musculus
agatgctagctcgcgatggtagtgc

SEQ ID NO: 122444 - DNA, 25 bp, mus musculus
gctagctcgcgatggtagtgcgcgc

SEQ ID NO: 122445 - DNA, 25 bp, mus musculus
accggtgtcggtgaccctgatcctg

SEQ ID NO: 122446 - DNA, 25 bp, mus musculus
tgtcggtgaccctgatcctggacac

SEQ ID NO: 122447 - DNA, 25 bp, mus musculus
gtcggtgaccctgatcctggacacc

SEQ ID NO: 122448 - DNA, 25 bp, mus musculus
cggtgaccctgatcctggacaccga

SEQ ID NO: 122449 - DNA, 25 bp, mus musculus
ggtgaccctgatcctggacaccgag

SEQ ID NO: 122450 - DNA, 25 bp, mus musculus
gaatcccaaagcaggatccttattg

SEQ ID NO: 122451 - DNA, 25 bp, mus musculus
agtcttcaaggactcattcttggga

SEQ ID NO: 122452 - DNA, 25 bp, mus musculus
caaggactcattcttgggacgcctg

SEQ ID NO: 122453 - DNA, 25 bp, mus musculus
gtagtcgtaacactcatgattgacg

SEQ ID NO: 122454 - DNA, 25 bp, mus musculus
acactcatgattgacgagcggagca

SEQ ID NO: 122455 - DNA, 25 bp, mus musculus
ctcatgattgacgagcggagcactt

SEQ ID NO: 122456 - DNA, 25 bp, mus musculus
tcttcttgttcgtgattgatgtggc

SEQ ID NO: 122457 - DNA, 25 bp, mus musculus
tcttgttcgtgattgatgtggcccg

SEQ ID NO: 122458 - DNA, 25 bp, mus musculus
tgattgatgtggcccgttcgttggg

SEQ ID NO: 122459 - DNA, 25 bp, mus musculus
gaatattgccacagtagttgaaaat

SEQ ID NO: 122460 - DNA, 25 bp, mus musculus
tattgccacagtagttgaaaatcat

SEQ ID NO: 122461 - DNA, 25 bp, mus musculus
tgtacttgtcgaggaacctgatgat

SEQ ID NO: 122462 - DNA, 25 bp, mus musculus
acttgtcgaggaacctgatgatgtt

SEQ ID NO: 122463 - DNA, 25 bp, mus musculus
ggactcattcttgggacgcctgcgt

SEQ ID NO: 122464 - DNA, 25 bp, mus musculus
ctcattcttgggacgcctgcgtttc

SEQ ID NO: 122465 - DNA, 25 bp, mus musculus
acgcctgcgtttcaaccgcacgact

SEQ ID NO: 122466 - DNA, 25 bp, mus musculus
gcgtttcaaccgcacgactcgcttg

SEQ ID NO: 122467 - DNA, 25 bp, mus musculus
caaccgcacgactcgcttgagcttg

SEQ ID NO: 122468 - DNA, 25 bp, mus musculus
ccaccgcttcacatgtctgtagtcg

SEQ ID NO: 122469 - DNA, 25 bp, mus musculus
ccgcttcacatgtctgtagtcgtaa

SEQ ID NO: 122470 - DNA, 25 bp, mus musculus
cttcacatgtctgtagtcgtaacac

SEQ ID NO: 122471 - DNA, 25 bp, mus musculus
caggtgctgcaccccaacatcatca

SEQ ID NO: 122472 - DNA, 25 bp, mus musculus
aacatcatcacgaggcacgacgtct

SEQ ID NO: 122473 - DNA, 25 bp, mus musculus
tgtttgatttcctggcccagaagga

SEQ ID NO: 122474 - DNA, 25 bp, mus musculus
ttgatttcctggcccagaaggagtc

SEQ ID NO: 122475 - DNA, 25 bp, mus musculus
aggaagccaccagcttcattaagca

SEQ ID NO: 122476 - DNA, 25 bp, mus musculus
aagccaccagcttcattaagcagat

SEQ ID NO: 122477 - DNA, 25 bp, mus musculus
ccaccagcttcattaagcagatcct

SEQ ID NO: 122478 - DNA, 25 bp, mus musculus
ccagcttcattaagcagatcctgga

SEQ ID NO: 122479 - DNA, 25 bp, mus musculus
gcttcattaagcagatcctggatgg

SEQ ID NO: 122480 - DNA, 25 bp, mus musculus
aaattgctcactttgatctcaagcc

SEQ ID NO: 122481 - DNA, 25 bp, mus musculus
ttgctcactttgatctcaagccaga

SEQ ID NO: 122482 - DNA, 25 bp, mus musculus
ttgatctcaagccagaaaacatcat

SEQ ID NO: 122483 - DNA, 25 bp, mus musculus
atcatcacgaggcacgacgtctatg

SEQ ID NO: 122484 - DNA, 25 bp, mus musculus
acaagaatatcccaattccacacat

SEQ ID NO: 122485 - DNA, 25 bp, mus musculus
atcacgaggcacgacgtctatgaga

SEQ ID NO: 122486 - DNA, 25 bp, mus musculus
acgaggcacgacgtctatgagaacc

SEQ ID NO: 122487 - DNA, 25 bp, mus musculus
gtctatgagaaccgcaccgacgtgg

SEQ ID NO: 122488 - DNA, 25 bp, mus musculus
tatgagaaccgcaccgacgtggtgc

SEQ ID NO: 122489 - DNA, 25 bp, mus musculus
aaccgcaccgacgtggtgctcatcc

SEQ ID NO: 122490 - DNA, 25 bp, mus musculus
accgacgtggtgctcatccttgagc

SEQ ID NO: 122491 - DNA, 25 bp, mus musculus
cttgagctagtgtccggagagaact

SEQ ID NO: 122492 - DNA, 25 bp, mus musculus
tctcctaagggagcaagtggcgcag

SEQ ID NO: 122493 - DNA, 25 bp, mus musculus
catgacccatgtcagcaacggctgc

SEQ ID NO: 122494 - DNA, 25 bp, mus musculus
tttttctgcaaagagactgaattca

SEQ ID NO: 122495 - DNA, 25 bp, mus musculus
ccgcttggtactcagcctgcgggga

SEQ ID NO: 122496 - DNA, 25 bp, mus musculus
cttggtactcagcctgcggggatac

SEQ ID NO: 122497 - DNA, 25 bp, mus musculus
ggtactcagcctgcggggatactag

SEQ ID NO: 122498 - DNA, 25 bp, mus musculus
ccctctgcatagtactgtggagaag

SEQ ID NO: 122499 - DNA, 25 bp, mus musculus
gaagaaacacgcacttcgtgtctaa

SEQ ID NO: 122500 - DNA, 25 bp, mus musculus
gaaacacgcacttcgtgtctaaagt

SEQ ID NO: 122501 - DNA, 25 bp, mus musculus
acacgcacttcgtgtctaaagtcta

SEQ ID NO: 122502 - DNA, 25 bp, mus musculus
cgcacttcgtgtctaaagtctattt

SEQ ID NO: 122503 - DNA, 25 bp, mus musculus
gcacttcgtgtctaaagtctatttt

SEQ ID NO: 122504 - DNA, 25 bp, mus musculus
gacccatgtcagcaacggctgccag

SEQ ID NO: 122505 - DNA, 25 bp, mus musculus
ccatgtcagcaacggctgccagttg

SEQ ID NO: 122506 - DNA, 25 bp, mus musculus
caacggctgccagttgctgctaggg

SEQ ID NO: 122507 - DNA, 25 bp, mus musculus
cggctgccagttgctgctaggggtc

SEQ ID NO: 122508 - DNA, 25 bp, mus musculus
ccagttgctgctaggggtcaaggga

SEQ ID NO: 122509 - DNA, 25 bp, mus musculus
gttgctgctaggggtcaagggacac

SEQ ID NO: 122510 - DNA, 25 bp, mus musculus
ggcgcagctcacacactggactccg

SEQ ID NO: 122511 - DNA, 25 bp, mus musculus
tccttccacctcgaggtttacatgg

SEQ ID NO: 122512 - DNA, 25 bp, mus musculus
tcaacagcggctgccagctgctgcc

SEQ ID NO: 122513 - DNA, 25 bp, mus musculus
cagcaccaggtcccggcgtactgag

SEQ ID NO: 122514 - DNA, 25 bp, mus musculus
gaacaaacgttggttgcgtgttgag

SEQ ID NO: 122515 - DNA, 25 bp, mus musculus
caaacgttggttgcgtgttgagtgt

SEQ ID NO: 122516 - DNA, 25 bp, mus musculus
aaacgttggttgcgtgttgagtgtg

SEQ ID NO: 122517 - DNA, 25 bp, mus musculus
aacgttggttgcgtgttgagtgtgt

SEQ ID NO: 122518 - DNA, 25 bp, mus musculus
tgttttgctacgagtccacattcct

SEQ ID NO: 122519 - DNA, 25 bp, mus musculus
ttgctacgagtccacattcctgttc

SEQ ID NO: 122520 - DNA, 25 bp, mus musculus
tgctacgagtccacattcctgttcc

SEQ ID NO: 122521 - DNA, 25 bp, mus musculus
gctacgagtccacattcctgttccg

SEQ ID NO: 122522 - DNA, 25 bp, mus musculus
tacgagtccacattcctgttccgta

SEQ ID NO: 122523 - DNA, 25 bp, mus musculus
cacattcctgttccgtaatcctggt

SEQ ID NO: 122524 - DNA, 25 bp, mus musculus
agcaccaggtcccggcgtactgagc

SEQ ID NO: 122525 - DNA, 25 bp, mus musculus
gcaccaggtcccggcgtactgagcc

SEQ ID NO: 122526 - DNA, 25 bp, mus musculus
ctttgatcctccgagtaggggctct

SEQ ID NO: 122527 - DNA, 25 bp, mus musculus
tttgatcctccgagtaggggctcta

SEQ ID NO: 122528 - DNA, 25 bp, mus musculus
ttgatcctccgagtaggggctctaa

SEQ ID NO: 122529 - DNA, 25 bp, mus musculus
gagtgtccgattccgccctatttat

SEQ ID NO: 122530 - DNA, 25 bp, mus musculus
agtgtccgattccgccctatttatg

SEQ ID NO: 122531 - DNA, 25 bp, mus musculus
gtgtccgattccgccctatttatgt

SEQ ID NO: 122532 - DNA, 25 bp, mus musculus
taatgaacacacatatgctttgatg

SEQ ID NO: 122533 - DNA, 25 bp, mus musculus
atgaacacacatatgctttgatgct

SEQ ID NO: 122534 - DNA, 25 bp, mus musculus
tcatttcttcaaagtgcttgtccag

SEQ ID NO: 122535 - DNA, 25 bp, mus musculus
atttcttcaaagtgcttgtccaggc

SEQ ID NO: 122536 - DNA, 25 bp, mus musculus
ttcttcaaagtgcttgtccaggcag

SEQ ID NO: 122537 - DNA, 25 bp, mus musculus
tgtagccatctctgtattagattag

SEQ ID NO: 122538 - DNA, 25 bp, mus musculus
aaatgcttgttttccatgtatcaaa

SEQ ID NO: 122539 - DNA, 25 bp, mus musculus
atgcttgttttccatgtatcaaaat

SEQ ID NO: 122540 - DNA, 25 bp, mus musculus
gcttgttttccatgtatcaaaatgt

SEQ ID NO: 122541 - DNA, 25 bp, mus musculus
ttgttttccatgtatcaaaatgtta

SEQ ID NO: 122542 - DNA, 25 bp, mus musculus
gttttccatgtatcaaaatgttatg

SEQ ID NO: 122543 - DNA, 25 bp, mus musculus
taattgtgccattgactccttgtgt

SEQ ID NO: 122544 - DNA, 25 bp, mus musculus
acacacatatgctttgatgcttttg

SEQ ID NO: 122545 - DNA, 25 bp, mus musculus
acacatatgctttgatgcttttgct

SEQ ID NO: 122546 - DNA, 25 bp, mus musculus
atatgctttgatgcttttgctaaac

SEQ ID NO: 122547 - DNA, 25 bp, mus musculus
tgatgcttttgctaaactcaaaata

SEQ ID NO: 122548 - DNA, 25 bp, mus musculus
atgcttttgctaaactcaaaatatt

SEQ ID NO: 122549 - DNA, 25 bp, mus musculus
ttcaaagcatgatccatgtaaaaat

SEQ ID NO: 122550 - DNA, 25 bp, mus musculus
ttctgtggggctttctcccatttct

SEQ ID NO: 122551 - DNA, 25 bp, mus musculus
cctcatttcttcaaagtgcttgtcc

SEQ ID NO: 122552 - DNA, 25 bp, mus musculus
cagatgatctctactgtgtgaacct

SEQ ID NO: 122553 - DNA, 25 bp, mus musculus
actgtgccaaagcccacatagagaa

SEQ ID NO: 122554 - DNA, 25 bp, mus musculus
tatcacaactgtctgttctcaataa

SEQ ID NO: 122555 - DNA, 25 bp, mus musculus
cacaactgtctgttctcaataaaag

SEQ ID NO: 122556 - DNA, 25 bp, mus musculus
tgtctgttctcaataaaaggcacca

SEQ ID NO: 122557 - DNA, 25 bp, mus musculus
aaaggcaccatgcaacaaatgagtt

SEQ ID NO: 122558 - DNA, 25 bp, mus musculus
tcaaggtctgacattctctgtcctg

SEQ ID NO: 122559 - DNA, 25 bp, mus musculus
attctctgtcctgctggagtgtgat

SEQ ID NO: 122560 - DNA, 25 bp, mus musculus
tgatcatgattcctcagctaaggcc

SEQ ID NO: 122561 - DNA, 25 bp, mus musculus
tcatgattcctcagctaaggccagg

SEQ ID NO: 122562 - DNA, 25 bp, mus musculus
ctcagctaaggccaggacttccaaa

SEQ ID NO: 122563 - DNA, 25 bp, mus musculus
taaggccaggacttccaaagtagat

SEQ ID NO: 122564 - DNA, 25 bp, mus musculus
gtgccaaagcccacatagagaaggt

SEQ ID NO: 122565 - DNA, 25 bp, mus musculus
aagcccacatagagaaggtgacaga

SEQ ID NO: 122566 - DNA, 25 bp, mus musculus
gccataccccatgcggtgaacctga

SEQ ID NO: 122567 - DNA, 25 bp, mus musculus
ataccccatgcggtgaacctgatat

SEQ ID NO: 122568 - DNA, 25 bp, mus musculus
aacctgatatgccaggcgtctacac

SEQ ID NO: 122569 - DNA, 25 bp, mus musculus
atatgccaggcgtctacaccaaact

SEQ ID NO: 122570 - DNA, 25 bp, mus musculus
tgccaggcgtctacaccaaacttaa

SEQ ID NO: 122571 - DNA, 25 bp, mus musculus
acccctaagtatcacaactgtctgt

SEQ ID NO: 122572 - DNA, 25 bp, mus musculus
ctttgcctttgtgatcccagtcctc

SEQ ID NO: 122573 - DNA, 25 bp, mus musculus
ctttgtgatcccagtcctcatcatc

SEQ ID NO: 122574 - DNA, 25 bp, mus musculus
ttggacccccattcacatctttatc

SEQ ID NO: 122575 - DNA, 25 bp, mus musculus
ccccattcacatctttatcctggtg

SEQ ID NO: 122576 - DNA, 25 bp, mus musculus
cctgaatcctgttctctatgccttt

SEQ ID NO: 122577 - DNA, 25 bp, mus musculus
tcctgttctctatgcctttctggat

SEQ ID NO: 122578 - DNA, 25 bp, mus musculus
ggacttctgcttccctattaagatg

SEQ ID NO: 122579 - DNA, 25 bp, mus musculus
ggagcgccagagcaccaatagagtt

SEQ ID NO: 122580 - DNA, 25 bp, mus musculus
cacagttcaggatcctgcttccatg

SEQ ID NO: 122581 - DNA, 25 bp, mus musculus
tcaggatcctgcttccatgagagat

SEQ ID NO: 122582 - DNA, 25 bp, mus musculus
gtcttcttattgttctccaggtaga

SEQ ID NO: 122583 - DNA, 25 bp, mus musculus
ttattgttctccaggtagagaagag

SEQ ID NO: 122584 - DNA, 25 bp, mus musculus
gatcccagtcctcatcatcattgtc

SEQ ID NO: 122585 - DNA, 25 bp, mus musculus
ggtttaacccagattacaactgcag

SEQ ID NO: 122586 - DNA, 25 bp, mus musculus
agtcctcatcatcattgtctgctac

SEQ ID NO: 122587 - DNA, 25 bp, mus musculus
cattgtctgctacaccctgatgatc

SEQ ID NO: 122588 - DNA, 25 bp, mus musculus
caccctgatgatcctgcgcctgaag

SEQ ID NO: 122589 - DNA, 25 bp, mus musculus
gatgatcctgcgcctgaagagtgtc

SEQ ID NO: 122590 - DNA, 25 bp, mus musculus
caccaagctggtgctggtagtagtt

SEQ ID NO: 122591 - DNA, 25 bp, mus musculus
agtagttgcagtcttcatcatctgt

SEQ ID NO: 122592 - DNA, 25 bp, mus musculus
catctgttggacccccattcacatc

SEQ ID NO: 122593 - DNA, 25 bp, mus musculus
gtacatggcatcttggaccaaatat

SEQ ID NO: 122594 - DNA, 25 bp, mus musculus
actgttgctcgatcctcgcagcatt

SEQ ID NO: 122595 - DNA, 25 bp, mus musculus
cttggtcactggcagaatctggaga

SEQ ID NO: 122596 - DNA, 25 bp, mus musculus
ttcagcttggcattttagtgcccaa

SEQ ID NO: 122597 - DNA, 25 bp, mus musculus
ttggcattttagtgcccaagccatc

SEQ ID NO: 122598 - DNA, 25 bp, mus musculus
tgcccaagccatcttctgactggta

SEQ ID NO: 122599 - DNA, 25 bp, mus musculus
agccatcttctgactggtagagcta

SEQ ID NO: 122600 - DNA, 25 bp, mus musculus
attagctgcacggctttgaaagata

SEQ ID NO: 122601 - DNA, 25 bp, mus musculus
tctctagttgtgatctgtcacagga

SEQ ID NO: 122602 - DNA, 25 bp, mus musculus
gttgtgatctgtcacaggagatgct

SEQ ID NO: 122603 - DNA, 25 bp, mus musculus
atctgtcacaggagatgctggcagg

SEQ ID NO: 122604 - DNA, 25 bp, mus musculus
gggtctacatcagtcctcaccactc

SEQ ID NO: 122605 - DNA, 25 bp, mus musculus
gctcgatcctcgcagcattcgaggt

SEQ ID NO: 122606 - DNA, 25 bp, mus musculus
tcgaggtttctccatcttagtgaca

SEQ ID NO: 122607 - DNA, 25 bp, mus musculus
catcagtcacgtggatgagatgcac

SEQ ID NO: 122608 - DNA, 25 bp, mus musculus
gatgcacgtttctgactgatcttcc

SEQ ID NO: 122609 - DNA, 25 bp, mus musculus
atgcctgggtcttgtaatatctcta

SEQ ID NO: 122610 - DNA, 25 bp, mus musculus
ggaagcagctacactcaggtccctt

SEQ ID NO: 122611 - DNA, 25 bp, mus musculus
ttacttagcttctggtcacttggtc

SEQ ID NO: 122612 - DNA, 25 bp, mus musculus
tggtcacttggtcactggcagaatc

SEQ ID NO: 122613 - DNA, 25 bp, mus musculus
gaaaccctgagcaactatgtgggtt

SEQ ID NO: 122614 - DNA, 25 bp, mus musculus
cactgaactcagatcctgtccaaga

SEQ ID NO: 122615 - DNA, 25 bp, mus musculus
ttttcacatgatgtgttagagtgtg

SEQ ID NO: 122616 - DNA, 25 bp, mus musculus
catctcaattactttaccatccaca

SEQ ID NO: 122617 - DNA, 25 bp, mus musculus
cactgggactcttacagatgcccat

SEQ ID NO: 122618 - DNA, 25 bp, mus musculus
tacagatgcccatgtgtagtttctc

SEQ ID NO: 122619 - DNA, 25 bp, mus musculus
tgcccatgtgtagtttctctattct

SEQ ID NO: 122620 - DNA, 25 bp, mus musculus
tgtgtagtttctctattctgtaaag

SEQ ID NO: 122621 - DNA, 25 bp, mus musculus
gtttctctattctgtaaaggagata

SEQ ID NO: 122622 - DNA, 25 bp, mus musculus
acctgaggtgcctggattctaatcc

SEQ ID NO: 122623 - DNA, 25 bp, mus musculus
cacagtctgtgtctgagctcatcta

SEQ ID NO: 122624 - DNA, 25 bp, mus musculus
ctgagctcatctacaaaacagtcat

SEQ ID NO: 122625 - DNA, 25 bp, mus musculus
actcagatcctgtccaagagcagcc

SEQ ID NO: 122626 - DNA, 25 bp, mus musculus
atcctgtccaagagcagccagtgct

SEQ ID NO: 122627 - DNA, 25 bp, mus musculus
tccaagagcagccagtgctctcaat

SEQ ID NO: 122628 - DNA, 25 bp, mus musculus
agccatgtctacagcttgaccctgt

SEQ ID NO: 122629 - DNA, 25 bp, mus musculus
gtctacagcttgaccctgtatatta

SEQ ID NO: 122630 - DNA, 25 bp, mus musculus
agtgctacaacatgaagcttttcac

SEQ ID NO: 122631 - DNA, 25 bp, mus musculus
acaacatgaagcttttcacatgatg

SEQ ID NO: 122632 - DNA, 25 bp, mus musculus
tgaagcttttcacatgatgtgttag

SEQ ID NO: 122633 - DNA, 25 bp, mus musculus
ttttgccagcccgtagcaaaccatg

SEQ ID NO: 122634 - DNA, 25 bp, mus musculus
cccgtagcaaaccatgctcttttct

SEQ ID NO: 122635 - DNA, 25 bp, mus musculus
agtggatggccttgagcagggctat

SEQ ID NO: 122636 - DNA, 25 bp, mus musculus
tggccttgagcagggctatgttgtt

SEQ ID NO: 122637 - DNA, 25 bp, mus musculus
ctatgttgtttgtccctctgagaag

SEQ ID NO: 122638 - DNA, 25 bp, mus musculus
tgttgtttgtccctctgagaagagg

SEQ ID NO: 122639 - DNA, 25 bp, mus musculus
tgtttgtccctctgagaagaggttc

SEQ ID NO: 122640 - DNA, 25 bp, mus musculus
gaggttccttctgcttttcacattc

SEQ ID NO: 122641 - DNA, 25 bp, mus musculus
ccttctgcttttcacattccttaag

SEQ ID NO: 122642 - DNA, 25 bp, mus musculus
tctgcttttcacattccttaagaag

SEQ ID NO: 122643 - DNA, 25 bp, mus musculus
cttttcatcttgtatgtctgtgaaa

SEQ ID NO: 122644 - DNA, 25 bp, mus musculus
ttcatcttgtatgtctgtgaaatac

SEQ ID NO: 122645 - DNA, 25 bp, mus musculus
gtagcaaaccatgctcttttctgcc

SEQ ID NO: 122646 - DNA, 25 bp, mus musculus
gcaaaccatgctcttttctgccaca

SEQ ID NO: 122647 - DNA, 25 bp, mus musculus
catgctcttttctgccacacaaact

SEQ ID NO: 122648 - DNA, 25 bp, mus musculus
gctcttttctgccacacaaactcga

SEQ ID NO: 122649 - DNA, 25 bp, mus musculus
ttctgccacacaaactcgaaaagtt

SEQ ID NO: 122650 - DNA, 25 bp, mus musculus
tttgtacgtgggtgttgatgacgac

SEQ ID NO: 122651 - DNA, 25 bp, mus musculus
agaggttgccacagtggatggcctt

SEQ ID NO: 122652 - DNA, 25 bp, mus musculus
ggttgccacagtggatggccttgag

SEQ ID NO: 122653 - DNA, 25 bp, mus musculus
aaagtgctgtccttctgcagggtca

SEQ ID NO: 122654 - DNA, 25 bp, mus musculus
ttcaggtgcctcccagaacttgaga

SEQ ID NO: 122655 - DNA, 25 bp, mus musculus
aaatcaagcgctacgaatcgcagct

SEQ ID NO: 122656 - DNA, 25 bp, mus musculus
agcgctacgaatcgcagcttcggga

SEQ ID NO: 122657 - DNA, 25 bp, mus musculus
acgaatcgcagcttcgggacctcga

SEQ ID NO: 122658 - DNA, 25 bp, mus musculus
ttcgggacctcgagcggcagtcaga

SEQ ID NO: 122659 - DNA, 25 bp, mus musculus
acctcgagcggcagtcagagcaaca

SEQ ID NO: 122660 - DNA, 25 bp, mus musculus
ttgcccaactgcagcaggagttcca

SEQ ID NO: 122661 - DNA, 25 bp, mus musculus
agttccagcgggcccaagctgcaaa

SEQ ID NO: 122662 - DNA, 25 bp, mus musculus
agcgggcccaagctgcaaaggctcc

SEQ ID NO: 122663 - DNA, 25 bp, mus musculus
cccaagctgcaaaggctcctgggaa

SEQ ID NO: 122664 - DNA, 25 bp, mus musculus
ctgcaaaggctcctgggaaagcctg

SEQ ID NO: 122665 - DNA, 25 bp, mus musculus
ccttcaccatggctgaactgatcca

SEQ ID NO: 122666 - DNA, 25 bp, mus musculus
atcaacagctgcagaaggacttgag

SEQ ID NO: 122667 - DNA, 25 bp, mus musculus
gtaaatctatgtcagggaggcagaa

SEQ ID NO: 122668 - DNA, 25 bp, mus musculus
agctggccctgctggatggatccaa

SEQ ID NO: 122669 - DNA, 25 bp, mus musculus
agcttctgggacccgtgcttgtcaa

SEQ ID NO: 122670 - DNA, 25 bp, mus musculus
tgggacccgtgcttgtcaaacagga

SEQ ID NO: 122671 - DNA, 25 bp, mus musculus
tagactacatcacagcagaaatcaa

SEQ ID NO: 122672 - DNA, 25 bp, mus musculus
acatcacagcagaaatcaagcgcta

SEQ ID NO: 122673 - DNA, 25 bp, mus musculus
tggctccagctcaggaggagcagga

SEQ ID NO: 122674 - DNA, 25 bp, mus musculus
aggttgtggctcaggtgtgaccttc

SEQ ID NO: 122675 - DNA, 25 bp, mus musculus
atactgtgttctgggaaagaatctg

SEQ ID NO: 122676 - DNA, 25 bp, mus musculus
tgtgtcttcaagccgttgtcccact

SEQ ID NO: 122677 - DNA, 25 bp, mus musculus
ctctcacattgtttacctggcatcc

SEQ ID NO: 122678 - DNA, 25 bp, mus musculus
cctcccagatggcgatgtgctgagg

SEQ ID NO: 122679 - DNA, 25 bp, mus musculus
tgtgctgaggaccccagggtagcct

SEQ ID NO: 122680 - DNA, 25 bp, mus musculus
tgtacatagcctcttgaatggactc

SEQ ID NO: 122681 - DNA, 25 bp, mus musculus
tagcctcttgaatggactctgcttt

SEQ ID NO: 122682 - DNA, 25 bp, mus musculus
tggactctgctttctgagtgttggg

SEQ ID NO: 122683 - DNA, 25 bp, mus musculus
actctgctttctgagtgttggggtc

SEQ ID NO: 122684 - DNA, 25 bp, mus musculus
tgttggggtctgggtctctgcataa

SEQ ID NO: 122685 - DNA, 25 bp, mus musculus
tggctcaggtgtgaccttctccttt

SEQ ID NO: 122686 - DNA, 25 bp, mus musculus
tgtgaccttctcctttagatagaga

SEQ ID NO: 122687 - DNA, 25 bp, mus musculus
gattccagaatgtcagctgttatct

SEQ ID NO: 122688 - DNA, 25 bp, mus musculus
tcagctgttatctctgtatctctaa

SEQ ID NO: 122689 - DNA, 25 bp, mus musculus
atctctgtatctctaactctgatta

SEQ ID NO: 122690 - DNA, 25 bp, mus musculus
gtatctctaactctgattaacccca

SEQ ID NO: 122691 - DNA, 25 bp, mus musculus
aatatttgtaatccacctgatgtga

SEQ ID NO: 122692 - DNA, 25 bp, mus musculus
gatgtctcttagcaattagagccag

SEQ ID NO: 122693 - DNA, 25 bp, mus musculus
gtcgacctagccaagatcctgagtg

SEQ ID NO: 122694 - DNA, 25 bp, mus musculus
gacctagccaagatcctgagtgaga

SEQ ID NO: 122695 - DNA, 25 bp, mus musculus
agcgtgatcagcggttttgaagccc

SEQ ID NO: 122696 - DNA, 25 bp, mus musculus
agcgacgtgcgtgccgacatagagc

SEQ ID NO: 122697 - DNA, 25 bp, mus musculus
gtgcgtgccgacatagagcgccaga

SEQ ID NO: 122698 - DNA, 25 bp, mus musculus
tataagcagctcatggacatcaagt

SEQ ID NO: 122699 - DNA, 25 bp, mus musculus
aagcagctcatggacatcaagtcca

SEQ ID NO: 122700 - DNA, 25 bp, mus musculus
gacatcaagtccaggctggagcagg

SEQ ID NO: 122701 - DNA, 25 bp, mus musculus
caggaagcccactacaacaatctgc

SEQ ID NO: 122702 - DNA, 25 bp, mus musculus
gaagcccactacaacaatctgccca

SEQ ID NO: 122703 - DNA, 25 bp, mus musculus
aaggccatctgagctaccagcgaga

SEQ ID NO: 122704 - DNA, 25 bp, mus musculus
tccctcgacttgtcaataaaactat

SEQ ID NO: 122705 - DNA, 25 bp, mus musculus
gaagccacctaccttgctcggattg

SEQ ID NO: 122706 - DNA, 25 bp, mus musculus
tgtcaataaaactatcctccaaggg

SEQ ID NO: 122707 - DNA, 25 bp, mus musculus
acctaccttgctcggattgaggagc

SEQ ID NO: 122708 - DNA, 25 bp, mus musculus
gtcgccgtccactctgagcagatcc

SEQ ID NO: 122709 - DNA, 25 bp, mus musculus
gccgtccactctgagcagatccaga

SEQ ID NO: 122710 - DNA, 25 bp, mus musculus
gtccactctgagcagatccagataa

SEQ ID NO: 122711 - DNA, 25 bp, mus musculus
ggagtccagctgtcacagatccaga

SEQ ID NO: 122712 - DNA, 25 bp, mus musculus
cagctgtcacagatccagagcgtga

SEQ ID NO: 122713 - DNA, 25 bp, mus musculus
atccagagcgtgatcagcggttttg

SEQ ID NO: 122714 - DNA, 25 bp, mus musculus
gtcagtacagcaggtgaccgagctg

SEQ ID NO: 122715 - DNA, 25 bp, mus musculus
cagtacagcaggtgaccgagctgac

SEQ ID NO: 122716 - DNA, 25 bp, mus musculus
gggtcatcagcagcatcgacagaag

SEQ ID NO: 122717 - DNA, 25 bp, mus musculus
ggtcatcagcagcatcgacagaaga

SEQ ID NO: 122718 - DNA, 25 bp, mus musculus
tcatcagcagcatcgacagaagacg

SEQ ID NO: 122719 - DNA, 25 bp, mus musculus
catcagcagcatcgacagaagacgt

SEQ ID NO: 122720 - DNA, 25 bp, mus musculus
tcagcagcatcgacagaagacgtct

SEQ ID NO: 122721 - DNA, 25 bp, mus musculus
tcgacagaagacgtctgcggacggc

SEQ ID NO: 122722 - DNA, 25 bp, mus musculus
gatcagatggtccgagcctaccggg

SEQ ID NO: 122723 - DNA, 25 bp, mus musculus
gtccgagcctaccgggagagatcga

SEQ ID NO: 122724 - DNA, 25 bp, mus musculus
tccgagcctaccgggagagatcgaa

SEQ ID NO: 122725 - DNA, 25 bp, mus musculus
cgagcctaccgggagagatcgaaag

SEQ ID NO: 122726 - DNA, 25 bp, mus musculus
agtacagcaggtgaccgagctgaca

SEQ ID NO: 122727 - DNA, 25 bp, mus musculus
gagcctaccgggagagatcgaaaga

SEQ ID NO: 122728 - DNA, 25 bp, mus musculus
tgaccgagctgacaaccactgtcca

SEQ ID NO: 122729 - DNA, 25 bp, mus musculus
gaccgagctgacaaccactgtccaa

SEQ ID NO: 122730 - DNA, 25 bp, mus musculus
ccgagctgacaaccactgtccaatg

SEQ ID NO: 122731 - DNA, 25 bp, mus musculus
cgagctgacaaccactgtccaatga

SEQ ID NO: 122732 - DNA, 25 bp, mus musculus
agctgacaaccactgtccaatgagg

SEQ ID NO: 122733 - DNA, 25 bp, mus musculus
gctgacaaccactgtccaatgagga

SEQ ID NO: 122734 - DNA, 25 bp, mus musculus
tgacaaccactgtccaatgaggaac

SEQ ID NO: 122735 - DNA, 25 bp, mus musculus
cacaagcaatgcatgcggcaagccc

SEQ ID NO: 122736 - DNA, 25 bp, mus musculus
caatgcatgcggcaagcccattggg

SEQ ID NO: 122737 - DNA, 25 bp, mus musculus
aacctaatggccagagcatctctgg

SEQ ID NO: 122738 - DNA, 25 bp, mus musculus
ctaatggccagagcatctctgggat

SEQ ID NO: 122739 - DNA, 25 bp, mus musculus
atggccagagcatctctgggatgac

SEQ ID NO: 122740 - DNA, 25 bp, mus musculus
agagcatctctgggatgacagtccc

SEQ ID NO: 122741 - DNA, 25 bp, mus musculus
tgacagtcccagaatctgtgtcttc

SEQ ID NO: 122742 - DNA, 25 bp, mus musculus
cagtcccagaatctgtgtcttcagc

SEQ ID NO: 122743 - DNA, 25 bp, mus musculus
gcctgcctcctattcttcattggac

SEQ ID NO: 122744 - DNA, 25 bp, mus musculus
ctattcttcattggactgctcagag

SEQ ID NO: 122745 - DNA, 25 bp, mus musculus
ggactgctcagaggactctgaagtg

SEQ ID NO: 122746 - DNA, 25 bp, mus musculus
ggactctgaagtgccagtggccctc

SEQ ID NO: 122747 - DNA, 25 bp, mus musculus
ccgctgtgggccatgcaactccttt

SEQ ID NO: 122748 - DNA, 25 bp, mus musculus
gccatgcaactcctttgtacgctag

SEQ ID NO: 122749 - DNA, 25 bp, mus musculus
atgcaactcctttgtacgctagaac

SEQ ID NO: 122750 - DNA, 25 bp, mus musculus
caactcctttgtacgctagaacctg

SEQ ID NO: 122751 - DNA, 25 bp, mus musculus
gacactgggcttagcactccagatg

SEQ ID NO: 122752 - DNA, 25 bp, mus musculus
cttagcactccagatggctgacctg

SEQ ID NO: 122753 - DNA, 25 bp, mus musculus
actccagatggctgacctggttctg

SEQ ID NO: 122754 - DNA, 25 bp, mus musculus
ggctgacctggttctggttccacaa

SEQ ID NO: 122755 - DNA, 25 bp, mus musculus
ccaccatttaaccgcctcttgatca

SEQ ID NO: 122756 - DNA, 25 bp, mus musculus
cgcctcttgatcacagtgctaaata

SEQ ID NO: 122757 - DNA, 25 bp, mus musculus
acccttcagctctaagcacttgtcc

SEQ ID NO: 122758 - DNA, 25 bp, mus musculus
cagctctaagcacttgtccagcaat

SEQ ID NO: 122759 - DNA, 25 bp, mus musculus
taagcacttgtccagcaatgcacaa

SEQ ID NO: 122760 - DNA, 25 bp, mus musculus
gcctcagctgctgtgacccaaggat

SEQ ID NO: 122761 - DNA, 25 bp, mus musculus
catcagggcttcctcatctcctttc

SEQ ID NO: 122762 - DNA, 25 bp, mus musculus
ctcatctcctttccatgtgccaacg

SEQ ID NO: 122763 - DNA, 25 bp, mus musculus
tcctttccatgtgccaacgcatttc

SEQ ID NO: 122764 - DNA, 25 bp, mus musculus
gccaacgcatttcgtgtctgagaaa

SEQ ID NO: 122765 - DNA, 25 bp, mus musculus
gcatttcgtgtctgagaaaattccc

SEQ ID NO: 122766 - DNA, 25 bp, mus musculus
catacctttatgaagctcaaagaaa

SEQ ID NO: 122767 - DNA, 25 bp, mus musculus
ttgatcacagtgctaaatagtgtat

SEQ ID NO: 122768 - DNA, 25 bp, mus musculus
gaggacatggccctgggtgttatta

SEQ ID NO: 122769 - DNA, 25 bp, mus musculus
cttaacaattccattttacactctg

SEQ ID NO: 122770 - DNA, 25 bp, mus musculus
attttacactctgtccaacttgtct

SEQ ID NO: 122771 - DNA, 25 bp, mus musculus
cactctgtccaacttgtctttgggt

SEQ ID NO: 122772 - DNA, 25 bp, mus musculus
gtccaacttgtctttgggtcaccag

SEQ ID NO: 122773 - DNA, 25 bp, mus musculus
ttgcaagtcactggcccagttgcaa

SEQ ID NO: 122774 - DNA, 25 bp, mus musculus
gtcactggcccagttgcaacccttc

SEQ ID NO: 122775 - DNA, 25 bp, mus musculus
ccaatgggcaccaagtccattttgc

SEQ ID NO: 122776 - DNA, 25 bp, mus musculus
attttgctgagccggcgtcccagag

SEQ ID NO: 122777 - DNA, 25 bp, mus musculus
gattaccagtctaagctggccatgt

SEQ ID NO: 122778 - DNA, 25 bp, mus musculus
aagctggccatgtccaagaagcagg

SEQ ID NO: 122779 - DNA, 25 bp, mus musculus
agcctgcaaagtatcctgagaaaga

SEQ ID NO: 122780 - DNA, 25 bp, mus musculus
cttgctccacagttctggcagccac

SEQ ID NO: 122781 - DNA, 25 bp, mus musculus
acacaagcaatcccagcctggtctc

SEQ ID NO: 122782 - DNA, 25 bp, mus musculus
caagctttgctcgctgtcaatgatt

SEQ ID NO: 122783 - DNA, 25 bp, mus musculus
ttgctcgctgtcaatgattattttc

SEQ ID NO: 122784 - DNA, 25 bp, mus musculus
tattttcactacaatggaagcaacc

SEQ ID NO: 122785 - DNA, 25 bp, mus musculus
tattctgtagcccaaatatagcgtt

SEQ ID NO: 122786 - DNA, 25 bp, mus musculus
caaatatagcgttcctaccaacatc

SEQ ID NO: 122787 - DNA, 25 bp, mus musculus
cggcgtcccagagacgacgactcca

SEQ ID NO: 122788 - DNA, 25 bp, mus musculus
cccagagacgacgactccaaggtgg

SEQ ID NO: 122789 - DNA, 25 bp, mus musculus
ggcagtgcaccacagaaggggttgc

SEQ ID NO: 122790 - DNA, 25 bp, mus musculus
gaatggaccctgatgcttcacggca

SEQ ID NO: 122791 - DNA, 25 bp, mus musculus
accctgatgcttcacggcacacaga

SEQ ID NO: 122792 - DNA, 25 bp, mus musculus
atgcttcacggcacacagagcgccc

SEQ ID NO: 122793 - DNA, 25 bp, mus musculus
acacagagcgccccatacatcgatc

SEQ ID NO: 122794 - DNA, 25 bp, mus musculus
agcgccccatacatcgatcaggtgg

SEQ ID NO: 122795 - DNA, 25 bp, mus musculus
tcatgtctttgtttctgcatgagaa

SEQ ID NO: 122796 - DNA, 25 bp, mus musculus
tgtctttgtttctgcatgagaaata

SEQ ID NO: 122797 - DNA, 25 bp, mus musculus
tttctcatgcaatgtgggtttcctg

SEQ ID NO: 122798 - DNA, 25 bp, mus musculus
ttttacacttgatttatatcctcga

SEQ ID NO: 122799 - DNA, 25 bp, mus musculus
acttgatttatatcctcgagatgat

SEQ ID NO: 122800 - DNA, 25 bp, mus musculus
tgatttatatcctcgagatgattgt

SEQ ID NO: 122801 - DNA, 25 bp, mus musculus
tttatatcctcgagatgattgtcat

SEQ ID NO: 122802 - DNA, 25 bp, mus musculus
ttgtcataagcttcttgcaatacaa

SEQ ID NO: 122803 - DNA, 25 bp, mus musculus
taagcttcttgcaatacaaatgttt

SEQ ID NO: 122804 - DNA, 25 bp, mus musculus
aatgttttctctcaaacatttcaat

SEQ ID NO: 122805 - DNA, 25 bp, mus musculus
acatttcaataaaaccattcttcag

SEQ ID NO: 122806 - DNA, 25 bp, mus musculus
cattcttcaggtataaagagaatta

SEQ ID NO: 122807 - DNA, 25 bp, mus musculus
aaatgatagctagtctcctgtgggg

SEQ ID NO: 122808 - DNA, 25 bp, mus musculus
atataggaccatgcagggattttat

SEQ ID NO: 122809 - DNA, 25 bp, mus musculus
tagaatccaccaaagaacatcattg

SEQ ID NO: 122810 - DNA, 25 bp, mus musculus
ccaccaaagaacatcattgtgactg

SEQ ID NO: 122811 - DNA, 25 bp, mus musculus
gggtccatacagctaagtctttgca

SEQ ID NO: 122812 - DNA, 25 bp, mus musculus
atacagctaagtctttgcacagtaa

SEQ ID NO: 122813 - DNA, 25 bp, mus musculus
ttatacaacatgcaaacaaacctac

SEQ ID NO: 122814 - DNA, 25 bp, mus musculus
tgttacatatttctcatgcaatgtg

SEQ ID NO: 122815 - DNA, 25 bp, mus musculus
gagtgatccacactaaggtgactat

SEQ ID NO: 122816 - DNA, 25 bp, mus musculus
tgatccacactaaggtgactattta

SEQ ID NO: 122817 - DNA, 25 bp, mus musculus
agtagtctaggcattcctatgtgat

SEQ ID NO: 122818 - DNA, 25 bp, mus musculus
agtctaggcattcctatgtgattat

SEQ ID NO: 122819 - DNA, 25 bp, mus musculus
ctaggcattcctatgtgattattgt

SEQ ID NO: 122820 - DNA, 25 bp, mus musculus
tgattattgtgtctctctaccactg

SEQ ID NO: 122821 - DNA, 25 bp, mus musculus
atttatatggcttcacagatatatt

SEQ ID NO: 122822 - DNA, 25 bp, mus musculus
tatatggcttcacagatatattgct

SEQ ID NO: 122823 - DNA, 25 bp, mus musculus
tattgctagttcagtcatagattgg

SEQ ID NO: 122824 - DNA, 25 bp, mus musculus
agtgtatgtccaacactattctaaa

SEQ ID NO: 122825 - DNA, 25 bp, mus musculus
gtatgtccaacactattctaaatag

SEQ ID NO: 122826 - DNA, 25 bp, mus musculus
tgtccaacactattctaaatagttt

SEQ ID NO: 122827 - DNA, 25 bp, mus musculus
tccacactaaggtgactatttatga

SEQ ID NO: 122828 - DNA, 25 bp, mus musculus
ttgtaaatgcacaactgccatctcc

SEQ ID NO: 122829 - DNA, 25 bp, mus musculus
taaatgcacaactgccatctccaaa

SEQ ID NO: 122830 - DNA, 25 bp, mus musculus
ttcatttactcaatttctaggctaa

SEQ ID NO: 122831 - DNA, 25 bp, mus musculus
tttccaatcaaaattcctatagtct

SEQ ID NO: 122832 - DNA, 25 bp, mus musculus
gtcttattttccagtagtctaggca

SEQ ID NO: 122833 - DNA, 25 bp, mus musculus
ttattttccagtagtctaggcattc

SEQ ID NO: 122834 - DNA, 25 bp, mus musculus
ttttccagtagtctaggcattccta

SEQ ID NO: 122835 - DNA, 25 bp, mus musculus
ctctaccagtgccttgagtgtgaca

SEQ ID NO: 122836 - DNA, 25 bp, mus musculus
taccagtgccttgagtgtgacaagt

SEQ ID NO: 122837 - DNA, 25 bp, mus musculus
aatgtgcggcccttcgtgtgcactg

SEQ ID NO: 122838 - DNA, 25 bp, mus musculus
gagttcagccagatccatcacctca

SEQ ID NO: 122839 - DNA, 25 bp, mus musculus
ttcagccagatccatcacctcaagc

SEQ ID NO: 122840 - DNA, 25 bp, mus musculus
agccagatccatcacctcaagcagc

SEQ ID NO: 122841 - DNA, 25 bp, mus musculus
tctctcactcacaagggtgtgtgag

SEQ ID NO: 122842 - DNA, 25 bp, mus musculus
cagttatgactgtctgcggccagtt

SEQ ID NO: 122843 - DNA, 25 bp, mus musculus
ttatgactgtctgcggccagttagt

SEQ ID NO: 122844 - DNA, 25 bp, mus musculus
tgactgtctgcggccagttagttca

SEQ ID NO: 122845 - DNA, 25 bp, mus musculus
ctgtctgcggccagttagttcacgc

SEQ ID NO: 122846 - DNA, 25 bp, mus musculus
tctgcggccagttagttcacgctgc

SEQ ID NO: 122847 - DNA, 25 bp, mus musculus
tgtgacaagtccttccactaccgca

SEQ ID NO: 122848 - DNA, 25 bp, mus musculus
ttccactaccgcagccagctacaaa

SEQ ID NO: 122849 - DNA, 25 bp, mus musculus
agccagctacaaaaccacatgctca

SEQ ID NO: 122850 - DNA, 25 bp, mus musculus
cagctacaaaaccacatgctcaagc

SEQ ID NO: 122851 - DNA, 25 bp, mus musculus
ctacaaaaccacatgctcaagcatc

SEQ ID NO: 122852 - DNA, 25 bp, mus musculus
aaccacatgctcaagcatcagaatg

SEQ ID NO: 122853 - DNA, 25 bp, mus musculus
cacatgctcaagcatcagaatgtgc

SEQ ID NO: 122854 - DNA, 25 bp, mus musculus
atgctcaagcatcagaatgtgcggc

SEQ ID NO: 122855 - DNA, 25 bp, mus musculus
aaagcatttatgatctcttgaaatg

SEQ ID NO: 122856 - DNA, 25 bp, mus musculus
gtgttgcaagtgtcctctgtgcctt

SEQ ID NO: 122857 - DNA, 25 bp, mus musculus
tatgctctgttttgtgacttaaaag

SEQ ID NO: 122858 - DNA, 25 bp, mus musculus
cctttgtagccaaatttcaggtgag

SEQ ID NO: 122859 - DNA, 25 bp, mus musculus
tgtgcttcaatgtcactgccgctga

SEQ ID NO: 122860 - DNA, 25 bp, mus musculus
gcttcaatgtcactgccgctgattt

SEQ ID NO: 122861 - DNA, 25 bp, mus musculus
tcaatgtcactgccgctgatttgtt

SEQ ID NO: 122862 - DNA, 25 bp, mus musculus
atgtcactgccgctgatttgtttgg

SEQ ID NO: 122863 - DNA, 25 bp, mus musculus
tcactgccgctgatttgtttggtta

SEQ ID NO: 122864 - DNA, 25 bp, mus musculus
ctgccgctgatttgtttggttatta

SEQ ID NO: 122865 - DNA, 25 bp, mus musculus
attagctcttaatagttgtggagag

SEQ ID NO: 122866 - DNA, 25 bp, mus musculus
aaccactaactggagttcagataat

SEQ ID NO: 122867 - DNA, 25 bp, mus musculus
ttgcaagtgtcctctgtgccttgtg

SEQ ID NO: 122868 - DNA, 25 bp, mus musculus
caagtgtcctctgtgccttgtgtga

SEQ ID NO: 122869 - DNA, 25 bp, mus musculus
gtgtcctctgtgccttgtgtgatgt

SEQ ID NO: 122870 - DNA, 25 bp, mus musculus
tctgtgccttgtgtgatgtgggcag

SEQ ID NO: 122871 - DNA, 25 bp, mus musculus
gtgttaacagggtctgcatgtgtac

SEQ ID NO: 122872 - DNA, 25 bp, mus musculus
gtacaggatgccttactatgggaac

SEQ ID NO: 122873 - DNA, 25 bp, mus musculus
caggatgccttactatgggaacaga

SEQ ID NO: 122874 - DNA, 25 bp, mus musculus
cactccttgggtttaagtatggctg

SEQ ID NO: 122875 - DNA, 25 bp, mus musculus
gacctgagtgccaaggcttctctga

SEQ ID NO: 122876 - DNA, 25 bp, mus musculus
ctgagtgccaaggcttctctgacag

SEQ ID NO: 122877 - DNA, 25 bp, mus musculus
tctgacaggttctcaccagttatgt

SEQ ID NO: 122878 - DNA, 25 bp, mus musculus
ctgacaggttctcaccagttatgtc

SEQ ID NO: 122879 - DNA, 25 bp, mus musculus
gacaggttctcaccagttatgtcag

SEQ ID NO: 122880 - DNA, 25 bp, mus musculus
acaggttctcaccagttatgtcagg

SEQ ID NO: 122881 - DNA, 25 bp, mus musculus
aggttctcaccagttatgtcaggag

SEQ ID NO: 122882 - DNA, 25 bp, mus musculus
ggttctcaccagttatgtcaggagt

SEQ ID NO: 122883 - DNA, 25 bp, mus musculus
ttctcaccagttatgtcaggagttc

SEQ ID NO: 122884 - DNA, 25 bp, mus musculus
tctcaccagttatgtcaggagttca

SEQ ID NO: 122885 - DNA, 25 bp, mus musculus
tcaccagttatgtcaggagttcacc

SEQ ID NO: 122886 - DNA, 25 bp, mus musculus
tcaggagttcaccttttccactggg

SEQ ID NO: 122887 - DNA, 25 bp, mus musculus
gagtgccaaggcttctctgacaggt

SEQ ID NO: 122888 - DNA, 25 bp, mus musculus
agtgccaaggcttctctgacaggtt

SEQ ID NO: 122889 - DNA, 25 bp, mus musculus
tgccaaggcttctctgacaggttct

SEQ ID NO: 122890 - DNA, 25 bp, mus musculus
gccaaggcttctctgacaggttctc

SEQ ID NO: 122891 - DNA, 25 bp, mus musculus
caaggcttctctgacaggttctcac

SEQ ID NO: 122892 - DNA, 25 bp, mus musculus
gcttctctgacaggttctcaccagt

SEQ ID NO: 122893 - DNA, 25 bp, mus musculus
ttctctgacaggttctcaccagtta

SEQ ID NO: 122894 - DNA, 25 bp, mus musculus
tctctgacaggttctcaccagttat

SEQ ID NO: 122895 - DNA, 25 bp, mus musculus
cagtggccacagaggtggctctgga

SEQ ID NO: 122896 - DNA, 25 bp, mus musculus
tggcgttaagtcctctggcagttct

SEQ ID NO: 122897 - DNA, 25 bp, mus musculus
cagtctgagtcccatggtaacaatc

SEQ ID NO: 122898 - DNA, 25 bp, mus musculus
gagtcccatggtaacaatcccactt

SEQ ID NO: 122899 - DNA, 25 bp, mus musculus
catggtaacaatcccactttatgtt

SEQ ID NO: 122900 - DNA, 25 bp, mus musculus
ttatgttctgctgaactgccatcag

SEQ ID NO: 122901 - DNA, 25 bp, mus musculus
gaactgccatcagttcatcaccaac

SEQ ID NO: 122902 - DNA, 25 bp, mus musculus
ccatcagttcatcaccaacatgaca

SEQ ID NO: 122903 - DNA, 25 bp, mus musculus
gttcatcaccaacatgacatttcaa

SEQ ID NO: 122904 - DNA, 25 bp, mus musculus
cccatatcctgcagcaacgctgagc

SEQ ID NO: 122905 - DNA, 25 bp, mus musculus
tcctgcagcaacgctgagccgcctt

SEQ ID NO: 122906 - DNA, 25 bp, mus musculus
gctgagccgccttaattttgtacat

SEQ ID NO: 122907 - DNA, 25 bp, mus musculus
taagtcctctggcagttctaccgtg

SEQ ID NO: 122908 - DNA, 25 bp, mus musculus
ctctggcagttctaccgtgaagttt

SEQ ID NO: 122909 - DNA, 25 bp, mus musculus
tagctctgcctttccatcaaggcca

SEQ ID NO: 122910 - DNA, 25 bp, mus musculus
tgcctttccatcaaggccaaacatg

SEQ ID NO: 122911 - DNA, 25 bp, mus musculus
caagaccaagatcaatcccaccagc

SEQ ID NO: 122912 - DNA, 25 bp, mus musculus
caagatcaatcccaccagccttatt

SEQ ID NO: 122913 - DNA, 25 bp, mus musculus
ttcttttctgctcctcttgcaaaga

SEQ ID NO: 122914 - DNA, 25 bp, mus musculus
tctgctcctcttgcaaagaagtttt

SEQ ID NO: 122915 - DNA, 25 bp, mus musculus
caccggaacctttgcaggctgcctg

SEQ ID NO: 122916 - DNA, 25 bp, mus musculus
gaacctttgcaggctgcctggggct

SEQ ID NO: 122917 - DNA, 25 bp, mus musculus
gctagtacctggttactatggtgaa

SEQ ID NO: 122918 - DNA, 25 bp, mus musculus
tagtacctggttactatggtgaagc

SEQ ID NO: 122919 - DNA, 25 bp, mus musculus
agtacctggttactatggtgaagct

SEQ ID NO: 122920 - DNA, 25 bp, mus musculus
aagctagctgccaaatgcatcctgg

SEQ ID NO: 122921 - DNA, 25 bp, mus musculus
agctagctgccaaatgcatcctggc

SEQ ID NO: 122922 - DNA, 25 bp, mus musculus
ctagctgccaaatgcatcctggcag

SEQ ID NO: 122923 - DNA, 25 bp, mus musculus
tagctgccaaatgcatcctggcagg

SEQ ID NO: 122924 - DNA, 25 bp, mus musculus
gactcagccgtacgaagacggccct

SEQ ID NO: 122925 - DNA, 25 bp, mus musculus
actcagccgtacgaagacggccctg

SEQ ID NO: 122926 - DNA, 25 bp, mus musculus
tcagccgtacgaagacggccctggt

SEQ ID NO: 122927 - DNA, 25 bp, mus musculus
caggctgcctggggctgaagcctcc

SEQ ID NO: 122928 - DNA, 25 bp, mus musculus
atcacggcctcaggccttggtgtca

SEQ ID NO: 122929 - DNA, 25 bp, mus musculus
tcacggcctcaggccttggtgtcag

SEQ ID NO: 122930 - DNA, 25 bp, mus musculus
tcaggccttggtgtcagctgtcccc

SEQ ID NO: 122931 - DNA, 25 bp, mus musculus
caggccttggtgtcagctgtccccg

SEQ ID NO: 122932 - DNA, 25 bp, mus musculus
gtctccgctagtacctggttactat

SEQ ID NO: 122933 - DNA, 25 bp, mus musculus
tccgctagtacctggttactatggt

SEQ ID NO: 122934 - DNA, 25 bp, mus musculus
cgctagtacctggttactatggtga

SEQ ID NO: 122935 - DNA, 25 bp, mus musculus
ggtgccacctgagggtagagtcctt

SEQ ID NO: 122936 - DNA, 25 bp, mus musculus
tagagtcctttcgtctatgattgaa

SEQ ID NO: 122937 - DNA, 25 bp, mus musculus
acgggccactggacagacgtgtgga

SEQ ID NO: 122938 - DNA, 25 bp, mus musculus
cacttttgtcttaatggtctgtgga

SEQ ID NO: 122939 - DNA, 25 bp, mus musculus
ttttgtcttaatggtctgtggaaat

SEQ ID NO: 122940 - DNA, 25 bp, mus musculus
tcttcttttcatctatcagaaagtg

SEQ ID NO: 122941 - DNA, 25 bp, mus musculus
tcttttcatctatcagaaagtgttc

SEQ ID NO: 122942 - DNA, 25 bp, mus musculus
tttcatctatcagaaagtgttcttt

SEQ ID NO: 122943 - DNA, 25 bp, mus musculus
atttcaataaactttcttactgatg

SEQ ID NO: 122944 - DNA, 25 bp, mus musculus
aactttcttactgatgcaaactatg

SEQ ID NO: 122945 - DNA, 25 bp, mus musculus
tttcttactgatgcaaactatgttg

SEQ ID NO: 122946 - DNA, 25 bp, mus musculus
cttactgatgcaaactatgttgggt

SEQ ID NO: 122947 - DNA, 25 bp, mus musculus
agtcctttcgtctatgattgaatca

SEQ ID NO: 122948 - DNA, 25 bp, mus musculus
caagaaacacttctattaagctgca

SEQ ID NO: 122949 - DNA, 25 bp, mus musculus
gaaacacttctattaagctgcatag

SEQ ID NO: 122950 - DNA, 25 bp, mus musculus
acacttctattaagctgcatagaag

SEQ ID NO: 122951 - DNA, 25 bp, mus musculus
gaagagtctcttcatacgggccact

SEQ ID NO: 122952 - DNA, 25 bp, mus musculus
gagtctcttcatacgggccactgga

SEQ ID NO: 122953 - DNA, 25 bp, mus musculus
cttcatacgggccactggacagacg

SEQ ID NO: 122954 - DNA, 25 bp, mus musculus
catacgggccactggacagacgtgt

SEQ ID NO: 122955 - DNA, 25 bp, mus musculus
ttcggcacaggtttgtgattacagc

SEQ ID NO: 122956 - DNA, 25 bp, mus musculus
aaagcagctccagctcctgcgctga

SEQ ID NO: 122957 - DNA, 25 bp, mus musculus
agttcacacctctgaacagtttgaa

SEQ ID NO: 122958 - DNA, 25 bp, mus musculus
gttcacacctctgaacagtttgaag

SEQ ID NO: 122959 - DNA, 25 bp, mus musculus
ttcacacctctgaacagtttgaaga

SEQ ID NO: 122960 - DNA, 25 bp, mus musculus
tcacacctctgaacagtttgaagag

SEQ ID NO: 122961 - DNA, 25 bp, mus musculus
cacacctctgaacagtttgaagagt

SEQ ID NO: 122962 - DNA, 25 bp, mus musculus
acacctctgaacagtttgaagagtt

SEQ ID NO: 122963 - DNA, 25 bp, mus musculus
ggccttcctgcttgttcgaccgcac

SEQ ID NO: 122964 - DNA, 25 bp, mus musculus
gccttcctgcttgttcgaccgcaca

SEQ ID NO: 122965 - DNA, 25 bp, mus musculus
ctgcttgttcgaccgcacacccaag

SEQ ID NO: 122966 - DNA, 25 bp, mus musculus
tgcttgttcgaccgcacacccaagg

SEQ ID NO: 122967 - DNA, 25 bp, mus musculus
aagcagctccagctcctgcgctgac

SEQ ID NO: 122968 - DNA, 25 bp, mus musculus
gcgctgacctgcactgcacctgcgg

SEQ ID NO: 122969 - DNA, 25 bp, mus musculus
taagatcgagttcacacctctgaac

SEQ ID NO: 122970 - DNA, 25 bp, mus musculus
aagatcgagttcacacctctgaaca

SEQ ID NO: 122971 - DNA, 25 bp, mus musculus
agatcgagttcacacctctgaacag

SEQ ID NO: 122972 - DNA, 25 bp, mus musculus
atcgagttcacacctctgaacagtt

SEQ ID NO: 122973 - DNA, 25 bp, mus musculus
tcgagttcacacctctgaacagttt

SEQ ID NO: 122974 - DNA, 25 bp, mus musculus
gagttcacacctctgaacagtttga

SEQ ID NO: 122975 - DNA, 25 bp, mus musculus
ggcgcaccatgcagaacctggagat

SEQ ID NO: 122976 - DNA, 25 bp, mus musculus
gcaccatgcagaacctggagatcga

SEQ ID NO: 122977 - DNA, 25 bp, mus musculus
ctgctggaagagcccctgtattgtc

SEQ ID NO: 122978 - DNA, 25 bp, mus musculus
ctggaagagcccctgtattgtccct

SEQ ID NO: 122979 - DNA, 25 bp, mus musculus
gaagagcccctgtattgtccctata

SEQ ID NO: 122980 - DNA, 25 bp, mus musculus
ctgtattgtccctataggcttcact

SEQ ID NO: 122981 - DNA, 25 bp, mus musculus
tattgtccctataggcttcactctt

SEQ ID NO: 122982 - DNA, 25 bp, mus musculus
ccctataggcttcactctttacttg

SEQ ID NO: 122983 - DNA, 25 bp, mus musculus
tataggcttcactctttacttgacc

SEQ ID NO: 122984 - DNA, 25 bp, mus musculus
gacccttgtccttcctggcaagcaa

SEQ ID NO: 122985 - DNA, 25 bp, mus musculus
ccttgtccttcctggcaagcaataa

SEQ ID NO: 122986 - DNA, 25 bp, mus musculus
tgtccttcctggcaagcaataaagc

SEQ ID NO: 122987 - DNA, 25 bp, mus musculus
accgccagatccgcaccaaggtcat

SEQ ID NO: 122988 - DNA, 25 bp, mus musculus
gccagatccgcaccaaggtcatgga

SEQ ID NO: 122989 - DNA, 25 bp, mus musculus
aggtcctgcgcaccaagaactaaag

SEQ ID NO: 122990 - DNA, 25 bp, mus musculus
tcctgcgcaccaagaactaaagctg

SEQ ID NO: 122991 - DNA, 25 bp, mus musculus
aaagctgctacatgctgctcaggct

SEQ ID NO: 122992 - DNA, 25 bp, mus musculus
gctgctacatgctgctcaggcttag

SEQ ID NO: 122993 - DNA, 25 bp, mus musculus
gctacatgctgctcaggcttaggag

SEQ ID NO: 122994 - DNA, 25 bp, mus musculus
ttaggaggctccgtggacgagatac

SEQ ID NO: 122995 - DNA, 25 bp, mus musculus
agatgtatcctccagtcgccaggtt

SEQ ID NO: 122996 - DNA, 25 bp, mus musculus
tcgcaccaaagtcgtggatgtacac

SEQ ID NO: 122997 - DNA, 25 bp, mus musculus
cttctctgcactgctcatgcctaga

SEQ ID NO: 122998 - DNA, 25 bp, mus musculus
tggacacagatttccctgggggatc

SEQ ID NO: 122999 - DNA, 25 bp, mus musculus
caagcacttgactcgtgagccctgt

SEQ ID NO: 123000 - DNA, 25 bp, mus musculus
gcacttgactcgtgagccctgtttc

SEQ ID NO: 123001 - DNA, 25 bp, mus musculus
cttgactcgtgagccctgtttcacc

SEQ ID NO: 123002 - DNA, 25 bp, mus musculus
gactcgtgagccctgtttcaccttg

SEQ ID NO: 123003 - DNA, 25 bp, mus musculus
tcgtgagccctgtttcaccttgccc

SEQ ID NO: 123004 - DNA, 25 bp, mus musculus
tgagccctgtttcaccttgcccctt

SEQ ID NO: 123005 - DNA, 25 bp, mus musculus
ccttccagcaatcaataaagcttca

SEQ ID NO: 123006 - DNA, 25 bp, mus musculus
cttccagcaatcaataaagcttcat

SEQ ID NO: 123007 - DNA, 25 bp, mus musculus
cacacacgagcagatcgttcgcacc

SEQ ID NO: 123008 - DNA, 25 bp, mus musculus
acacgagcagatcgttcgcaccaag

SEQ ID NO: 123009 - DNA, 25 bp, mus musculus
gatcgttcgcaccaagaactaaggc

SEQ ID NO: 123010 - DNA, 25 bp, mus musculus
tcgcaccaagaactaaggcttctct

SEQ ID NO: 123011 - DNA, 25 bp, mus musculus
caagaactaaggcttctctgcactg

SEQ ID NO: 123012 - DNA, 25 bp, mus musculus
gaactaaggcttctctgcactgctc

SEQ ID NO: 123013 - DNA, 25 bp, mus musculus
ctaaggcttctctgcactgctcatg

SEQ ID NO: 123014 - DNA, 25 bp, mus musculus
aggcttctctgcactgctcatgcct

SEQ ID NO: 123015 - DNA, 25 bp, mus musculus
attttggttcgcgacccatacagct

SEQ ID NO: 123016 - DNA, 25 bp, mus musculus
gttcgcgacccatacagctcgactg

SEQ ID NO: 123017 - DNA, 25 bp, mus musculus
aatatccatacgttgaggcgatttc

SEQ ID NO: 123018 - DNA, 25 bp, mus musculus
cgtgttgatccatctctatggatcc

SEQ ID NO: 123019 - DNA, 25 bp, mus musculus
gatccatctctatggatcctgaacc

SEQ ID NO: 123020 - DNA, 25 bp, mus musculus
tggatcctgaacctactgaacactc

SEQ ID NO: 123021 - DNA, 25 bp, mus musculus
ttgatgtccaggttgtcagcgccgg

SEQ ID NO: 123022 - DNA, 25 bp, mus musculus
atgtccaggttgtcagcgccggggc

SEQ ID NO: 123023 - DNA, 25 bp, mus musculus
tccaggttgtcagcgccggggcgac

SEQ ID NO: 123024 - DNA, 25 bp, mus musculus
aggttgtcagcgccggggcgactca

SEQ ID NO: 123025 - DNA, 25 bp, mus musculus
gggcgactcaggcaccatgagccag

SEQ ID NO: 123026 - DNA, 25 bp, mus musculus
cgactcaggcaccatgagccaggac

SEQ ID NO: 123027 - DNA, 25 bp, mus musculus
cgcgacccatacagctcgactgtct

SEQ ID NO: 123028 - DNA, 25 bp, mus musculus
tacagctcgactgtctgggtcacaa

SEQ ID NO: 123029 - DNA, 25 bp, mus musculus
agctcgactgtctgggtcacaacta

SEQ ID NO: 123030 - DNA, 25 bp, mus musculus
tcgactgtctgggtcacaactacca

SEQ ID NO: 123031 - DNA, 25 bp, mus musculus
gtctgggtcacaactaccaatatcc

SEQ ID NO: 123032 - DNA, 25 bp, mus musculus
gtcacaactaccaatatccatacgt

SEQ ID NO: 123033 - DNA, 25 bp, mus musculus
actaccaatatccatacgttgaggc

SEQ ID NO: 123034 - DNA, 25 bp, mus musculus
accaatatccatacgttgaggcgat

SEQ ID NO: 123035 - DNA, 25 bp, mus musculus
ttggaccagtcaacatctctgtggt

SEQ ID NO: 123036 - DNA, 25 bp, mus musculus
cagtcaacatctctgtggtgcagtc

SEQ ID NO: 123037 - DNA, 25 bp, mus musculus
tgtcaccaagagcttgtctctggtc

SEQ ID NO: 123038 - DNA, 25 bp, mus musculus
tgtcatggctgcagctgaaccacat

SEQ ID NO: 123039 - DNA, 25 bp, mus musculus
tgttgcacgtcagcacctatacatg

SEQ ID NO: 123040 - DNA, 25 bp, mus musculus
acgtcagcacctatacatgttcttt

SEQ ID NO: 123041 - DNA, 25 bp, mus musculus
atacatgttctttggtgacccagac

SEQ ID NO: 123042 - DNA, 25 bp, mus musculus
tggtgacccagaccccaaaatgttg

SEQ ID NO: 123043 - DNA, 25 bp, mus musculus
cccagaccccaaaatgttgcagaat

SEQ ID NO: 123044 - DNA, 25 bp, mus musculus
gaatacccacctaaattctgtcatg

SEQ ID NO: 123045 - DNA, 25 bp, mus musculus
ggttctgacttcctccagagtctgt

SEQ ID NO: 123046 - DNA, 25 bp, mus musculus
gacttcctccagagtctgtaaaata

SEQ ID NO: 123047 - DNA, 25 bp, mus musculus
ctgtggtgcagtccaccgtgtccag

SEQ ID NO: 123048 - DNA, 25 bp, mus musculus
tgtccagcggctatggcagtgccgg

SEQ ID NO: 123049 - DNA, 25 bp, mus musculus
gaggcagcagctactcctatagcag

SEQ ID NO: 123050 - DNA, 25 bp, mus musculus
gcagctactcctatagcagcagcca

SEQ ID NO: 123051 - DNA, 25 bp, mus musculus
tcagtgctggcagtggcagagccat

SEQ ID NO: 123052 - DNA, 25 bp, mus musculus
gtggcctcagctcttctggtggcct

SEQ ID NO: 123053 - DNA, 25 bp, mus musculus
tcagctcttctggtggcctcagctc

SEQ ID NO: 123054 - DNA, 25 bp, mus musculus
cttctggtggcctcagctcttctac

SEQ ID NO: 123055 - DNA, 25 bp, mus musculus
aacgtccgcttcacatacaggagcg

SEQ ID NO: 123056 - DNA, 25 bp, mus musculus
gagaatccagtcctgcagcagcact

SEQ ID NO: 123057 - DNA, 25 bp, mus musculus
agaagcccagccactttctacactg

SEQ ID NO: 123058 - DNA, 25 bp, mus musculus
agcccagccactttctacactgcag

SEQ ID NO: 123059 - DNA, 25 bp, mus musculus
actttctacactgcagccaggccac

SEQ ID NO: 123060 - DNA, 25 bp, mus musculus
ttctacactgcagccaggccacctg

SEQ ID NO: 123061 - DNA, 25 bp, mus musculus
gccaggccacctgcttgtgttctta

SEQ ID NO: 123062 - DNA, 25 bp, mus musculus
aggccacctgcttgtgttcttacca

SEQ ID NO: 123063 - DNA, 25 bp, mus musculus
gcttgtgttcttaccaagctaggtg

SEQ ID NO: 123064 - DNA, 25 bp, mus musculus
tgtgttcttaccaagctaggtggta

SEQ ID NO: 123065 - DNA, 25 bp, mus musculus
cttaccaagctaggtggtagctaca

SEQ ID NO: 123066 - DNA, 25 bp, mus musculus
cacctcactgtgccttactctgtga

SEQ ID NO: 123067 - DNA, 25 bp, mus musculus
aatccagtcctgcagcagcacttcc

SEQ ID NO: 123068 - DNA, 25 bp, mus musculus
ctgtgccttactctgtgaataaagc

SEQ ID NO: 123069 - DNA, 25 bp, mus musculus
ctgcagcagcacttccgcaacctgg

SEQ ID NO: 123070 - DNA, 25 bp, mus musculus
cagcagcacttccgcaacctggagg

SEQ ID NO: 123071 - DNA, 25 bp, mus musculus
gacatatgcaaggctcatgggctta

SEQ ID NO: 123072 - DNA, 25 bp, mus musculus
atatgcaaggctcatgggcttaaga

SEQ ID NO: 123073 - DNA, 25 bp, mus musculus
gatgctcttatcagacacttggaga

SEQ ID NO: 123074 - DNA, 25 bp, mus musculus
ctaaagctcagaagcccagccactt

SEQ ID NO: 123075 - DNA, 25 bp, mus musculus
aagctcagaagcccagccactttct

SEQ ID NO: 123076 - DNA, 25 bp, mus musculus
attactgtggacctggtcatcggcc

SEQ ID NO: 123077 - DNA, 25 bp, mus musculus
actgtggacctggtcatcggcccta

SEQ ID NO: 123078 - DNA, 25 bp, mus musculus
gagacccaggcagtcctgcagctgg

SEQ ID NO: 123079 - DNA, 25 bp, mus musculus
gcagtcctgcagctgggcatcgagg

SEQ ID NO: 123080 - DNA, 25 bp, mus musculus
ctgcagctgggcatcgagggtgccc

SEQ ID NO: 123081 - DNA, 25 bp, mus musculus
tgtctatcaaaacgtcgtccctggc

SEQ ID NO: 123082 - DNA, 25 bp, mus musculus
ctatcaaaacgtcgtccctggcaga

SEQ ID NO: 123083 - DNA, 25 bp, mus musculus
cgtcgtccctggcagaggctgagaa

SEQ ID NO: 123084 - DNA, 25 bp, mus musculus
cgtccctggcagaggctgagaacat

SEQ ID NO: 123085 - DNA, 25 bp, mus musculus
acatggctgacctcatagatggcta

SEQ ID NO: 123086 - DNA, 25 bp, mus musculus
tcatagatggctactgcaggctgca

SEQ ID NO: 123087 - DNA, 25 bp, mus musculus
tagatggctactgcaggctgcaagg

SEQ ID NO: 123088 - DNA, 25 bp, mus musculus
gtcatcggccctaaaggcatccgtc

SEQ ID NO: 123089 - DNA, 25 bp, mus musculus
ggccctaaaggcatccgtcagctga

SEQ ID NO: 123090 - DNA, 25 bp, mus musculus
cctaaaggcatccgtcagctgacaa

SEQ ID NO: 123091 - DNA, 25 bp, mus musculus
atccgtcagctgacaagtcaagata

SEQ ID NO: 123092 - DNA, 25 bp, mus musculus
caagatacaaagcccacctgcctgg

SEQ ID NO: 123093 - DNA, 25 bp, mus musculus
aagcagatcaaatccatcaggtgcc

SEQ ID NO: 123094 - DNA, 25 bp, mus musculus
aaatccatcaggtgcctcccattgg

SEQ ID NO: 123095 - DNA, 25 bp, mus musculus
tccatcaggtgcctcccattggaag

SEQ ID NO: 123096 - DNA, 25 bp, mus musculus
atacccgtctgtctcgccgagtatt

SEQ ID NO: 123097 - DNA, 25 bp, mus musculus
cccgtctgtctcgccgagtattgag

SEQ ID NO: 123098 - DNA, 25 bp, mus musculus
atgtgatcattcctagaggtgccga

SEQ ID NO: 123099 - DNA, 25 bp, mus musculus
tcattcctagaggtgccgacaatct

SEQ ID NO: 123100 - DNA, 25 bp, mus musculus
ttcctagaggtgccgacaatctcgt

SEQ ID NO: 123101 - DNA, 25 bp, mus musculus
gtgccgacaatctcgtggccatcaa

SEQ ID NO: 123102 - DNA, 25 bp, mus musculus
ccgacaatctcgtggccatcaacct

SEQ ID NO: 123103 - DNA, 25 bp, mus musculus
acaatctcgtggccatcaacctcat

SEQ ID NO: 123104 - DNA, 25 bp, mus musculus
ggctctccaagcggcagacgaacgg

SEQ ID NO: 123105 - DNA, 25 bp, mus musculus
tctccaagcggcagacgaacggcta

SEQ ID NO: 123106 - DNA, 25 bp, mus musculus
agacgaacggctatctcaacggcta

SEQ ID NO: 123107 - DNA, 25 bp, mus musculus
cttcccgcaagaggcaggcgtcaga

SEQ ID NO: 123108 - DNA, 25 bp, mus musculus
tgtctcgccgagtattgagggacat

SEQ ID NO: 123109 - DNA, 25 bp, mus musculus
agattttatcacagtacattacgtt

SEQ ID NO: 123110 - DNA, 25 bp, mus musculus
ttttatcacagtacattacgtttgt

SEQ ID NO: 123111 - DNA, 25 bp, mus musculus
cacagtacattacgtttgtgaagcc

SEQ ID NO: 123112 - DNA, 25 bp, mus musculus
agtacattacgtttgtgaagcctgc

SEQ ID NO: 123113 - DNA, 25 bp, mus musculus
aattctgcttgccaacaaagaaata

SEQ ID NO: 123114 - DNA, 25 bp, mus musculus
tctgcttgccaacaaagaaatacgc

SEQ ID NO: 123115 - DNA, 25 bp, mus musculus
caaagaaatacgccgatgtgatcat

SEQ ID NO: 123116 - DNA, 25 bp, mus musculus
attcggaccatgcggatccatgatt

SEQ ID NO: 123117 - DNA, 25 bp, mus musculus
tcggaccatgcggatccatgattat

SEQ ID NO: 123118 - DNA, 25 bp, mus musculus
cctatggtcagctacctccaggggg

SEQ ID NO: 123119 - DNA, 25 bp, mus musculus
gtccctacggtacatagcctggaca

SEQ ID NO: 123120 - DNA, 25 bp, mus musculus
ccctacggtacatagcctggacatt

SEQ ID NO: 123121 - DNA, 25 bp, mus musculus
ggtacatagcctggacattatggac

SEQ ID NO: 123122 - DNA, 25 bp, mus musculus
tacatagcctggacattatggacag

SEQ ID NO: 123123 - DNA, 25 bp, mus musculus
catagcctggacattatggacaggg

SEQ ID NO: 123124 - DNA, 25 bp, mus musculus
atgtggatcctgaggcctactcctg

SEQ ID NO: 123125 - DNA, 25 bp, mus musculus
atcctgaggcctactcctggttcca

SEQ ID NO: 123126 - DNA, 25 bp, mus musculus
cctgaggcctactcctggttccagt

SEQ ID NO: 123127 - DNA, 25 bp, mus musculus
aggcctactcctggttccagtcagt

SEQ ID NO: 123128 - DNA, 25 bp, mus musculus
cggatccatgattatcctggtcctc

SEQ ID NO: 123129 - DNA, 25 bp, mus musculus
accctatggataccccagtgctgga

SEQ ID NO: 123130 - DNA, 25 bp, mus musculus
cctatggataccccagtgctggagg

SEQ ID NO: 123131 - DNA, 25 bp, mus musculus
tatggataccccagtgctggaggag

SEQ ID NO: 123132 - DNA, 25 bp, mus musculus
gggaactccaagtggaccatatggc

SEQ ID NO: 123133 - DNA, 25 bp, mus musculus
tccaagtggaccatatggcggtata

SEQ ID NO: 123134 - DNA, 25 bp, mus musculus
caagtggaccatatggcggtatacc

SEQ ID NO: 123135 - DNA, 25 bp, mus musculus
ggtccctatggtcagctacctccag

SEQ ID NO: 123136 - DNA, 25 bp, mus musculus
ctcccatgttgggagacatcatgtg

SEQ ID NO: 123137 - DNA, 25 bp, mus musculus
agacatcatgtggcaagtgacaaag

SEQ ID NO: 123138 - DNA, 25 bp, mus musculus
ttttgacacttctggagtttgggca

SEQ ID NO: 123139 - DNA, 25 bp, mus musculus
tttgacacttctggagtttgggcaa

SEQ ID NO: 123140 - DNA, 25 bp, mus musculus
tgacacttctggagtttgggcaagg

SEQ ID NO: 123141 - DNA, 25 bp, mus musculus
gacacttctggagtttgggcaagga

SEQ ID NO: 123142 - DNA, 25 bp, mus musculus
tacttgtcctgcatcttctccaaga

SEQ ID NO: 123143 - DNA, 25 bp, mus musculus
acttgtcctgcatcttctccaagat

SEQ ID NO: 123144 - DNA, 25 bp, mus musculus
cttgtcctgcatcttctccaagata

SEQ ID NO: 123145 - DNA, 25 bp, mus musculus
tgtcctgcatcttctccaagatagg

SEQ ID NO: 123146 - DNA, 25 bp, mus musculus
ctgcatcttctccaagataggcaca

SEQ ID NO: 123147 - DNA, 25 bp, mus musculus
tgcatcttctccaagataggcacaa

SEQ ID NO: 123148 - DNA, 25 bp, mus musculus
gtcccataactggggtagtaccatg

SEQ ID NO: 123149 - DNA, 25 bp, mus musculus
gcatcttctccaagataggcacaat

SEQ ID NO: 123150 - DNA, 25 bp, mus musculus
tcccataactggggtagtaccatga

SEQ ID NO: 123151 - DNA, 25 bp, mus musculus
ccagccatgttttgacacttctgga

SEQ ID NO: 123152 - DNA, 25 bp, mus musculus
cagccatgttttgacacttctggag

SEQ ID NO: 123153 - DNA, 25 bp, mus musculus
agccatgttttgacacttctggagt

SEQ ID NO: 123154 - DNA, 25 bp, mus musculus
ccatgttttgacacttctggagttt

SEQ ID NO: 123155 - DNA, 25 bp, mus musculus
catgttttgacacttctggagtttg

SEQ ID NO: 123156 - DNA, 25 bp, mus musculus
atgttttgacacttctggagtttgg

SEQ ID NO: 123157 - DNA, 25 bp, mus musculus
actttgtgtcctgttcagacagcgc

SEQ ID NO: 123158 - DNA, 25 bp, mus musculus
tgccccaagtggctgaccacctgga

SEQ ID NO: 123159 - DNA, 25 bp, mus musculus
tccctatcaccctgaaagagctgga

SEQ ID NO: 123160 - DNA, 25 bp, mus musculus
acggctcctgcaggacatactatgg

SEQ ID NO: 123161 - DNA, 25 bp, mus musculus
actatggctactctcaagctcacag

SEQ ID NO: 123162 - DNA, 25 bp, mus musculus
gctactctcaagctcacagcatcca

SEQ ID NO: 123163 - DNA, 25 bp, mus musculus
ctcaagctcacagcatccacttgca

SEQ ID NO: 123164 - DNA, 25 bp, mus musculus
ctcacagcatccacttgcagacagg

SEQ ID NO: 123165 - DNA, 25 bp, mus musculus
gtctccatcttctgtgacatccgac

SEQ ID NO: 123166 - DNA, 25 bp, mus musculus
agtgctctctgagctcagggaagac

SEQ ID NO: 123167 - DNA, 25 bp, mus musculus
cctgttgtccgtgcagaaccacacc

SEQ ID NO: 123168 - DNA, 25 bp, mus musculus
tacctggggacagctcaagacacag

SEQ ID NO: 123169 - DNA, 25 bp, mus musculus
ctgaccacctggaccacatcaagaa

SEQ ID NO: 123170 - DNA, 25 bp, mus musculus
acctggaccacatcaagaaggtggc

SEQ ID NO: 123171 - DNA, 25 bp, mus musculus
tgcttcctgtgggactggaggatgt

SEQ ID NO: 123172 - DNA, 25 bp, mus musculus
cagacctgatagctgagcttctcag

SEQ ID NO: 123173 - DNA, 25 bp, mus musculus
tgatagctgagcttctcaggaggaa

SEQ ID NO: 123174 - DNA, 25 bp, mus musculus
gtttgctagctgacaacctgattcg

SEQ ID NO: 123175 - DNA, 25 bp, mus musculus
tagctgacaacctgattcgggtctt

SEQ ID NO: 123176 - DNA, 25 bp, mus musculus
tgcagtctcctgaggaagtccctat

SEQ ID NO: 123177 - DNA, 25 bp, mus musculus
catactgcttccatccatactccag

SEQ ID NO: 123178 - DNA, 25 bp, mus musculus
gcttccatccatactccagagaatc

SEQ ID NO: 123179 - DNA, 25 bp, mus musculus
gtttataatctatgccgctgcatta

SEQ ID NO: 123180 - DNA, 25 bp, mus musculus
tataatctatgccgctgcattaaaa

SEQ ID NO: 123181 - DNA, 25 bp, mus musculus
ctatgccgctgcattaaaagggaca

SEQ ID NO: 123182 - DNA, 25 bp, mus musculus
tgccgctgcattaaaagggacatcc

SEQ ID NO: 123183 - DNA, 25 bp, mus musculus
gtcttgaggtgccgagttgtctttc

SEQ ID NO: 123184 - DNA, 25 bp, mus musculus
ttgaggtgccgagttgtctttcaga

SEQ ID NO: 123185 - DNA, 25 bp, mus musculus
tgccgagttgtctttcagaacgaat

SEQ ID NO: 123186 - DNA, 25 bp, mus musculus
cctgcccacatggtctttgttgaac

SEQ ID NO: 123187 - DNA, 25 bp, mus musculus
gcccacatggtctttgttgaaccag

SEQ ID NO: 123188 - DNA, 25 bp, mus musculus
tttgttgaaccagacttgtaatgct

SEQ ID NO: 123189 - DNA, 25 bp, mus musculus
tccatccatactccagagaatcgag

SEQ ID NO: 123190 - DNA, 25 bp, mus musculus
atccatactccagagaatcgagagg

SEQ ID NO: 123191 - DNA, 25 bp, mus musculus
aattttgactaccctgcttggtctg

SEQ ID NO: 123192 - DNA, 25 bp, mus musculus
taccctgcttggtctggactcgaag

SEQ ID NO: 123193 - DNA, 25 bp, mus musculus
gaactgcagtcacctaacgaagaca

SEQ ID NO: 123194 - DNA, 25 bp, mus musculus
ctgcagtcacctaacgaagacactc

SEQ ID NO: 123195 - DNA, 25 bp, mus musculus
cagtcacctaacgaagacactcatc

SEQ ID NO: 123196 - DNA, 25 bp, mus musculus
cctaacgaagacactcatctttttg

SEQ ID NO: 123197 - DNA, 25 bp, mus musculus
ttcagtgctgattggctagttcctc

SEQ ID NO: 123198 - DNA, 25 bp, mus musculus
tggctagttcctctattccgagctc

SEQ ID NO: 123199 - DNA, 25 bp, mus musculus
attacgctccttcgacacagccatt

SEQ ID NO: 123200 - DNA, 25 bp, mus musculus
cgacacagccattgcctttattgta

SEQ ID NO: 123201 - DNA, 25 bp, mus musculus
agccattgcctttattgtatagttc

SEQ ID NO: 123202 - DNA, 25 bp, mus musculus
tgcccgcacagaacagattgtttta

SEQ ID NO: 123203 - DNA, 25 bp, mus musculus
gaattttcctttgattccaactgtg

SEQ ID NO: 123204 - DNA, 25 bp, mus musculus
aactgtggcccttttcaatgtgcct

SEQ ID NO: 123205 - DNA, 25 bp, mus musculus
ggcccttttcaatgtgccttcactt

SEQ ID NO: 123206 - DNA, 25 bp, mus musculus
ttcactttagctgtttgccttaatc

SEQ ID NO: 123207 - DNA, 25 bp, mus musculus
ttagctgtttgccttaatctctaca

SEQ ID NO: 123208 - DNA, 25 bp, mus musculus
gtttgccttaatctctacagccatt

SEQ ID NO: 123209 - DNA, 25 bp, mus musculus
ctattccgagctcaccaccttaaca

SEQ ID NO: 123210 - DNA, 25 bp, mus musculus
cgagctcaccaccttaacattttgg

SEQ ID NO: 123211 - DNA, 25 bp, mus musculus
cttaacattttggtcacagttgcaa

SEQ ID NO: 123212 - DNA, 25 bp, mus musculus
attttggtcacagttgcaagaaaat

SEQ ID NO: 123213 - DNA, 25 bp, mus musculus
accagcatcctttgggtcaactcca

SEQ ID NO: 123214 - DNA, 25 bp, mus musculus
tctccagcttttggctggtatattt

SEQ ID NO: 123215 - DNA, 25 bp, mus musculus
agatgataccttattacgctccttc

SEQ ID NO: 123216 - DNA, 25 bp, mus musculus
taccttattacgctccttcgacaca

SEQ ID NO: 123217 - DNA, 25 bp, mus musculus
cgggacctcatcagccacgattcga

SEQ ID NO: 123218 - DNA, 25 bp, mus musculus
ggacctcatcagccacgattcgatg

SEQ ID NO: 123219 - DNA, 25 bp, mus musculus
atctatcagatccgggagatagccg

SEQ ID NO: 123220 - DNA, 25 bp, mus musculus
ctatcagatccgggagatagccgac

SEQ ID NO: 123221 - DNA, 25 bp, mus musculus
ttttgcctgcacgtggatcggcaga

SEQ ID NO: 123222 - DNA, 25 bp, mus musculus
ttgcctgcacgtggatcggcagatg

SEQ ID NO: 123223 - DNA, 25 bp, mus musculus
gcctgcacgtggatcggcagatggt

SEQ ID NO: 123224 - DNA, 25 bp, mus musculus
ctgcacgtggatcggcagatggtcc

SEQ ID NO: 123225 - DNA, 25 bp, mus musculus
gcacgtggatcggcagatggtccgt

SEQ ID NO: 123226 - DNA, 25 bp, mus musculus
tccgtatgcccgaaggtaacattga

SEQ ID NO: 123227 - DNA, 25 bp, mus musculus
cgtatgcccgaaggtaacattgatg

SEQ ID NO: 123228 - DNA, 25 bp, mus musculus
tatgcccgaaggtaacattgatgaa

SEQ ID NO: 123229 - DNA, 25 bp, mus musculus
acctcatcagccacgattcgatgtt

SEQ ID NO: 123230 - DNA, 25 bp, mus musculus
ctcatcagccacgattcgatgttct

SEQ ID NO: 123231 - DNA, 25 bp, mus musculus
catcagccacgattcgatgttctcc

SEQ ID NO: 123232 - DNA, 25 bp, mus musculus
tcagccacgattcgatgttctccga

SEQ ID NO: 123233 - DNA, 25 bp, mus musculus
agccacgattcgatgttctccgaca

SEQ ID NO: 123234 - DNA, 25 bp, mus musculus
ccacgattcgatgttctccgacatc

SEQ ID NO: 123235 - DNA, 25 bp, mus musculus
ttcgatgttctccgacatctatcag

SEQ ID NO: 123236 - DNA, 25 bp, mus musculus
cgatgttctccgacatctatcagat

SEQ ID NO: 123237 - DNA, 25 bp, mus musculus
gctatgagctgcccgacggggttcc

SEQ ID NO: 123238 - DNA, 25 bp, mus musculus
ctatgagctgcccgacggggttcca

SEQ ID NO: 123239 - DNA, 25 bp, mus musculus
gctcttcaagccttccttaatggga

SEQ ID NO: 123240 - DNA, 25 bp, mus musculus
cttcaagccttccttaatgggaatg

SEQ ID NO: 123241 - DNA, 25 bp, mus musculus
caagccttccttaatgggaatgaat

SEQ ID NO: 123242 - DNA, 25 bp, mus musculus
ccttccttaatgggaatgaattctg

SEQ ID NO: 123243 - DNA, 25 bp, mus musculus
ccctggtatcgctgaccgctatgca

SEQ ID NO: 123244 - DNA, 25 bp, mus musculus
tggtatcgctgaccgctatgcagaa

SEQ ID NO: 123245 - DNA, 25 bp, mus musculus
ggtatcgctgaccgctatgcagaag

SEQ ID NO: 123246 - DNA, 25 bp, mus musculus
atcgctgaccgctatgcagaaggag

SEQ ID NO: 123247 - DNA, 25 bp, mus musculus
cgctgaccgctatgcagaaggagtt

SEQ ID NO: 123248 - DNA, 25 bp, mus musculus
gctgaccgctatgcagaaggagttc

SEQ ID NO: 123249 - DNA, 25 bp, mus musculus
atgagctgcccgacggggttccatc

SEQ ID NO: 123250 - DNA, 25 bp, mus musculus
tgagctgcccgacggggttccatca

SEQ ID NO: 123251 - DNA, 25 bp, mus musculus
tgcccgacggggttccatcaccatc

SEQ ID NO: 123252 - DNA, 25 bp, mus musculus
acggggttccatcaccatcggcaat

SEQ ID NO: 123253 - DNA, 25 bp, mus musculus
cggggttccatcaccatcggcaatg

SEQ ID NO: 123254 - DNA, 25 bp, mus musculus
ggttccatcaccatcggcaatgagc

SEQ ID NO: 123255 - DNA, 25 bp, mus musculus
gaagctcttcaagccttccttaatg

SEQ ID NO: 123256 - DNA, 25 bp, mus musculus
aagctcttcaagccttccttaatgg

SEQ ID NO: 123257 - DNA, 25 bp, mus musculus
aggataacagccacctaccagccca

SEQ ID NO: 123258 - DNA, 25 bp, mus musculus
gccagagctctctgtgatggcaagt

SEQ ID NO: 123259 - DNA, 25 bp, mus musculus
gcccacatcaaacagaactgcctga

SEQ ID NO: 123260 - DNA, 25 bp, mus musculus
cagaactgcctgagcagccgggcct

SEQ ID NO: 123261 - DNA, 25 bp, mus musculus
agcagccgggcctcattccggggct

SEQ ID NO: 123262 - DNA, 25 bp, mus musculus
cgggcctcattccggggctgtgtga

SEQ ID NO: 123263 - DNA, 25 bp, mus musculus
agccgagcctttgacctacaaggag

SEQ ID NO: 123264 - DNA, 25 bp, mus musculus
actgtcgccagcctctgcccttgga

SEQ ID NO: 123265 - DNA, 25 bp, mus musculus
gccagcctctgcccttggaatcatc

SEQ ID NO: 123266 - DNA, 25 bp, mus musculus
ccttggaatcatcgccaacgcatgg

SEQ ID NO: 123267 - DNA, 25 bp, mus musculus
cattgccatctcaggttatgtttcc

SEQ ID NO: 123268 - DNA, 25 bp, mus musculus
acaacagatacctctattaaatggt

SEQ ID NO: 123269 - DNA, 25 bp, mus musculus
gctctctgtgatggcaagtggcaca

SEQ ID NO: 123270 - DNA, 25 bp, mus musculus
caagcccacaaaagcaagcaccgca

SEQ ID NO: 123271 - DNA, 25 bp, mus musculus
cacaaaagcaagcaccgcatcgtcc

SEQ ID NO: 123272 - DNA, 25 bp, mus musculus
caccgcatcgtcctgactgtggacg

SEQ ID NO: 123273 - DNA, 25 bp, mus musculus
atcgtcctgactgtggacgggaatt

SEQ ID NO: 123274 - DNA, 25 bp, mus musculus
tcggcagacaccaacgatcccattt

SEQ ID NO: 123275 - DNA, 25 bp, mus musculus
gacaccaacgatcccatttatgtgg

SEQ ID NO: 123276 - DNA, 25 bp, mus musculus
ggtggctatcctgcccacatcaaac

SEQ ID NO: 123277 - DNA, 25 bp, mus musculus
ctttttctgtctcagatcagtgtcc

SEQ ID NO: 123278 - DNA, 25 bp, mus musculus
ttttctgtctcagatcagtgtccct

SEQ ID NO: 123279 - DNA, 25 bp, mus musculus
atgccagtgggcaagcactgagttg

SEQ ID NO: 123280 - DNA, 25 bp, mus musculus
caaaccgccgtgcctaaggactctg

SEQ ID NO: 123281 - DNA, 25 bp, mus musculus
cgtgcctaaggactctgtcaggccc

SEQ ID NO: 123282 - DNA, 25 bp, mus musculus
tgcctaaggactctgtcaggcccgt

SEQ ID NO: 123283 - DNA, 25 bp, mus musculus
taaggactctgtcaggcccgtctgg

SEQ ID NO: 123284 - DNA, 25 bp, mus musculus
gactctgtcaggcccgtctggtagc

SEQ ID NO: 123285 - DNA, 25 bp, mus musculus
ctctgtcaggcccgtctggtagcca

SEQ ID NO: 123286 - DNA, 25 bp, mus musculus
tctggtagccacagccctagagtga

SEQ ID NO: 123287 - DNA, 25 bp, mus musculus
tggtagccacagccctagagtgaag

SEQ ID NO: 123288 - DNA, 25 bp, mus musculus
gtagccacagccctagagtgaaggg

SEQ ID NO: 123289 - DNA, 25 bp, mus musculus
ttctgtctcagatcagtgtccctca

SEQ ID NO: 123290 - DNA, 25 bp, mus musculus
ctgtctcagatcagtgtccctcaaa

SEQ ID NO: 123291 - DNA, 25 bp, mus musculus
ctcagatcagtgtccctcaaatgtg

SEQ ID NO: 123292 - DNA, 25 bp, mus musculus
cagatcagtgtccctcaaatgtggc

SEQ ID NO: 123293 - DNA, 25 bp, mus musculus
gatcagtgtccctcaaatgtggccc

SEQ ID NO: 123294 - DNA, 25 bp, mus musculus
tcagtgtccctcaaatgtggcccaa

SEQ ID NO: 123295 - DNA, 25 bp, mus musculus
tgtccctcaaatgtggcccaaggga

SEQ ID NO: 123296 - DNA, 25 bp, mus musculus
gggctgatgccagtgggcaagcact

SEQ ID NO: 123297 - DNA, 25 bp, mus musculus
tgcgtgtccgggcattaattgaagc

SEQ ID NO: 123298 - DNA, 25 bp, mus musculus
gctctccctagatgggcggtctgct

SEQ ID NO: 123299 - DNA, 25 bp, mus musculus
ttggtcaactacttctcttacattg

SEQ ID NO: 123300 - DNA, 25 bp, mus musculus
aactacttctcttacattgttgact

SEQ ID NO: 123301 - DNA, 25 bp, mus musculus
tacttctcttacattgttgactcat

SEQ ID NO: 123302 - DNA, 25 bp, mus musculus
ttctcttacattgttgactcatgag

SEQ ID NO: 123303 - DNA, 25 bp, mus musculus
aaggctttctcttcaaattcgctag

SEQ ID NO: 123304 - DNA, 25 bp, mus musculus
gctttctcttcaaattcgctagttg

SEQ ID NO: 123305 - DNA, 25 bp, mus musculus
ttctcttcaaattcgctagttgagt

SEQ ID NO: 123306 - DNA, 25 bp, mus musculus
tgcttacatttcttatccgacatta

SEQ ID NO: 123307 - DNA, 25 bp, mus musculus
ttacatttcttatccgacattaaca

SEQ ID NO: 123308 - DNA, 25 bp, mus musculus
catttcttatccgacattaacaaat

SEQ ID NO: 123309 - DNA, 25 bp, mus musculus
ctccctagatgggcggtctgctctc

SEQ ID NO: 123310 - DNA, 25 bp, mus musculus
cggtccttctctgctctctataaaa

SEQ ID NO: 123311 - DNA, 25 bp, mus musculus
ttctctgctctctataaaatggtgc

SEQ ID NO: 123312 - DNA, 25 bp, mus musculus
ttaatctagtcacccatgtacgcac

SEQ ID NO: 123313 - DNA, 25 bp, mus musculus
tagtcacccatgtacgcactctgga

SEQ ID NO: 123314 - DNA, 25 bp, mus musculus
tacgcactctggatggaggttctac

SEQ ID NO: 123315 - DNA, 25 bp, mus musculus
gttctacagagctgttgattggtca

SEQ ID NO: 123316 - DNA, 25 bp, mus musculus
ctacagagctgttgattggtcaact

SEQ ID NO: 123317 - DNA, 25 bp, mus musculus
ggatgctgcacatactgactgatgt

SEQ ID NO: 123318 - DNA, 25 bp, mus musculus
tgcacatactgactgatgtatccgc

SEQ ID NO: 123319 - DNA, 25 bp, mus musculus
tgaataacacgctgaactacgacct

SEQ ID NO: 123320 - DNA, 25 bp, mus musculus
acacgctgaactacgacctgaccgg

SEQ ID NO: 123321 - DNA, 25 bp, mus musculus
cgctgaactacgacctgaccggcga

SEQ ID NO: 123322 - DNA, 25 bp, mus musculus
tgaactacgacctgaccggcgacgc

SEQ ID NO: 123323 - DNA, 25 bp, mus musculus
tgctcaagacagtcgacggcaatgt

SEQ ID NO: 123324 - DNA, 25 bp, mus musculus
cagtcgacggcaatgtcaagaacga

SEQ ID NO: 123325 - DNA, 25 bp, mus musculus
acgactatgtctaaccagctgactt

SEQ ID NO: 123326 - DNA, 25 bp, mus musculus
atgtctaaccagctgacttcatgga

SEQ ID NO: 123327 - DNA, 25 bp, mus musculus
atgtcatctacatcgtctagatcag

SEQ ID NO: 123328 - DNA, 25 bp, mus musculus
tctacatcgtctagatcagcgataa

SEQ ID NO: 123329 - DNA, 25 bp, mus musculus
tactgactgatgtatccgctcaaca

SEQ ID NO: 123330 - DNA, 25 bp, mus musculus
ccgctcaacatacgtctgccagcta

SEQ ID NO: 123331 - DNA, 25 bp, mus musculus
cgtctgccagctagcatcgcttgag

SEQ ID NO: 123332 - DNA, 25 bp, mus musculus
ctgccagctagcatcgcttgagaca

SEQ ID NO: 123333 - DNA, 25 bp, mus musculus
atcgcttgagacaatgcatggcgct

SEQ ID NO: 123334 - DNA, 25 bp, mus musculus
aatgcatggcgctcgacatctacat

SEQ ID NO: 123335 - DNA, 25 bp, mus musculus
cgctcgacatctacatgaataacac

SEQ ID NO: 123336 - DNA, 25 bp, mus musculus
tctacatgaataacacgctgaacta

SEQ ID NO: 123337 - DNA, 25 bp, mus musculus
taagcgtaaagctgcccagaactct

SEQ ID NO: 123338 - DNA, 25 bp, mus musculus
gcgtaaagctgcccagaactctggg

SEQ ID NO: 123339 - DNA, 25 bp, mus musculus
cagcaagctccagctgttggaagac

SEQ ID NO: 123340 - DNA, 25 bp, mus musculus
caagctccagctgttggaagactta

SEQ ID NO: 123341 - DNA, 25 bp, mus musculus
tgcggtttacagcacctgcttataa

SEQ ID NO: 123342 - DNA, 25 bp, mus musculus
ttacagcacctgcttataacaggaa

SEQ ID NO: 123343 - DNA, 25 bp, mus musculus
cagcacctgcttataacaggaaggg

SEQ ID NO: 123344 - DNA, 25 bp, mus musculus
taaaccacacgcgcaaaccgaggca

SEQ ID NO: 123345 - DNA, 25 bp, mus musculus
acacgcgcaaaccgaggcagtcatc

SEQ ID NO: 123346 - DNA, 25 bp, mus musculus
cgcgcaaaccgaggcagtcatctac

SEQ ID NO: 123347 - DNA, 25 bp, mus musculus
gcaaaccgaggcagtcatctacaaa

SEQ ID NO: 123348 - DNA, 25 bp, mus musculus
agtcatctacaaataacccatcatc

SEQ ID NO: 123349 - DNA, 25 bp, mus musculus
agagtcagcagatgccaggaggaaa

SEQ ID NO: 123350 - DNA, 25 bp, mus musculus
agctgagctgctacaaaatgaagca

SEQ ID NO: 123351 - DNA, 25 bp, mus musculus
agcaaaaacactcttggctcaagct

SEQ ID NO: 123352 - DNA, 25 bp, mus musculus
aacactcttggctcaagctaacagc

SEQ ID NO: 123353 - DNA, 25 bp, mus musculus
cttggctcaagctaacagcaagctc

SEQ ID NO: 123354 - DNA, 25 bp, mus musculus
ggctcaagctaacagcaagctccag

SEQ ID NO: 123355 - DNA, 25 bp, mus musculus
tcaagctaacagcaagctccagctg

SEQ ID NO: 123356 - DNA, 25 bp, mus musculus
taacagcaagctccagctgttggaa

SEQ ID NO: 123357 - DNA, 25 bp, mus musculus
gcttacctgttcctcaggtagccag

SEQ ID NO: 123358 - DNA, 25 bp, mus musculus
ttacctgttcctcaggtagccagcc

SEQ ID NO: 123359 - DNA, 25 bp, mus musculus
ggcgcgtctccatggaggatgctca

SEQ ID NO: 123360 - DNA, 25 bp, mus musculus
cgcgtctccatggaggatgctcaca

SEQ ID NO: 123361 - DNA, 25 bp, mus musculus
ggatgctcacaactgtattcctgag

SEQ ID NO: 123362 - DNA, 25 bp, mus musculus
gctcacaactgtattcctgagctgg

SEQ ID NO: 123363 - DNA, 25 bp, mus musculus
tcacaactgtattcctgagctggac

SEQ ID NO: 123364 - DNA, 25 bp, mus musculus
aactgtattcctgagctggacaatg

SEQ ID NO: 123365 - DNA, 25 bp, mus musculus
ctgtattcctgagctggacaatgag

SEQ ID NO: 123366 - DNA, 25 bp, mus musculus
gtattcctgagctggacaatgagac

SEQ ID NO: 123367 - DNA, 25 bp, mus musculus
attcctgagctggacaatgagacag

SEQ ID NO: 123368 - DNA, 25 bp, mus musculus
gagacagccatgttttctgtctacg

SEQ ID NO: 123369 - DNA, 25 bp, mus musculus
ctgttcctcaggtagccagccatcc

SEQ ID NO: 123370 - DNA, 25 bp, mus musculus
cagccatgttttctgtctacgatgg

SEQ ID NO: 123371 - DNA, 25 bp, mus musculus
gttcctcaggtagccagccatccgc

SEQ ID NO: 123372 - DNA, 25 bp, mus musculus
tctctcagcccaacacggtgaagtg

SEQ ID NO: 123373 - DNA, 25 bp, mus musculus
agcccaacacggtgaagtgctccgg

SEQ ID NO: 123374 - DNA, 25 bp, mus musculus
acggcttctccgccatgcaaggctg

SEQ ID NO: 123375 - DNA, 25 bp, mus musculus
cttctccgccatgcaaggctggcgc

SEQ ID NO: 123376 - DNA, 25 bp, mus musculus
ccatgcaaggctggcgcgtctccat

SEQ ID NO: 123377 - DNA, 25 bp, mus musculus
atgcaaggctggcgcgtctccatgg

SEQ ID NO: 123378 - DNA, 25 bp, mus musculus
gctcgtgaccgtgatggttggcagc

SEQ ID NO: 123379 - DNA, 25 bp, mus musculus
cgtgaccgtgatggttggcagcccc

SEQ ID NO: 123380 - DNA, 25 bp, mus musculus
cttggagcctggaatcccacagtgg

SEQ ID NO: 123381 - DNA, 25 bp, mus musculus
aatcccacagtgggccaattatgtc

SEQ ID NO: 123382 - DNA, 25 bp, mus musculus
gattcaacattacccagcttccccg

SEQ ID NO: 123383 - DNA, 25 bp, mus musculus
gctcgttggcttcagtgcagtggtg

SEQ ID NO: 123384 - DNA, 25 bp, mus musculus
cgttggcttcagtgcagtggtggtc

SEQ ID NO: 123385 - DNA, 25 bp, mus musculus
gctttccagctcagcgtctctggaa

SEQ ID NO: 123386 - DNA, 25 bp, mus musculus
cagctcagcgtctctggaagtggcc

SEQ ID NO: 123387 - DNA, 25 bp, mus musculus
gtctctggaagtggccacgtacacc

SEQ ID NO: 123388 - DNA, 25 bp, mus musculus
agtggccacgtacaccttcatccag

SEQ ID NO: 123389 - DNA, 25 bp, mus musculus
ggccacgtacaccttcatccagcag

SEQ ID NO: 123390 - DNA, 25 bp, mus musculus
tgggcttgtttctcttctcaccact

SEQ ID NO: 123391 - DNA, 25 bp, mus musculus
tctcaccacttccaaagatgcagac

SEQ ID NO: 123392 - DNA, 25 bp, mus musculus
cacttccaaagatgcagacgacccc

SEQ ID NO: 123393 - DNA, 25 bp, mus musculus
actgccctcagcccagtggtccttg

SEQ ID NO: 123394 - DNA, 25 bp, mus musculus
ctcagcccagtggtccttggagcct

SEQ ID NO: 123395 - DNA, 25 bp, mus musculus
agcccagtggtccttggagcctgga

SEQ ID NO: 123396 - DNA, 25 bp, mus musculus
ccagtggtccttggagcctggaatc

SEQ ID NO: 123397 - DNA, 25 bp, mus musculus
gtccttggagcctggaatcccacag

SEQ ID NO: 123398 - DNA, 25 bp, mus musculus
ggttaggctgcacacttaagaagca

SEQ ID NO: 123399 - DNA, 25 bp, mus musculus
acacaggcacgcacagggtcaacct

SEQ ID NO: 123400 - DNA, 25 bp, mus musculus
gagctgccactttcctaaatagaaa

SEQ ID NO: 123401 - DNA, 25 bp, mus musculus
tttccagtcttgtgttggcgttcag

SEQ ID NO: 123402 - DNA, 25 bp, mus musculus
tgttggcgttcagggtggccctgtc

SEQ ID NO: 123403 - DNA, 25 bp, mus musculus
ctctgcactgtgtacaataatagat

SEQ ID NO: 123404 - DNA, 25 bp, mus musculus
aatagattcacactgctgacgtgtc

SEQ ID NO: 123405 - DNA, 25 bp, mus musculus
tgtacactgggcatcagctcacgta

SEQ ID NO: 123406 - DNA, 25 bp, mus musculus
ctgggcatcagctcacgtaatgcat

SEQ ID NO: 123407 - DNA, 25 bp, mus musculus
atcagctcacgtaatgcattgcctg

SEQ ID NO: 123408 - DNA, 25 bp, mus musculus
tcacgtaatgcattgcctgtaacga

SEQ ID NO: 123409 - DNA, 25 bp, mus musculus
aatgcattgcctgtaacgatgctaa

SEQ ID NO: 123410 - DNA, 25 bp, mus musculus
gcacgcacagggtcaacctctggac

SEQ ID NO: 123411 - DNA, 25 bp, mus musculus
acagggtcaacctctggacacttgg

SEQ ID NO: 123412 - DNA, 25 bp, mus musculus
tcaacctctggacacttggcttggg

SEQ ID NO: 123413 - DNA, 25 bp, mus musculus
cacttggcttgggctacctggcctt

SEQ ID NO: 123414 - DNA, 25 bp, mus musculus
actctggcatctggctgggtacaca

SEQ ID NO: 123415 - DNA, 25 bp, mus musculus
caatttctgtgctctgccacccgtg

SEQ ID NO: 123416 - DNA, 25 bp, mus musculus
ctgtgctctgccacccgtgagctgc

SEQ ID NO: 123417 - DNA, 25 bp, mus musculus
tctgccacccgtgagctgccacttt

SEQ ID NO: 123418 - DNA, 25 bp, mus musculus
agccaagcaggacccctgatccttc

SEQ ID NO: 123419 - DNA, 25 bp, mus musculus
caagcaggacccctgatccttccag

SEQ ID NO: 123420 - DNA, 25 bp, mus musculus
tatttcaatctctccaagaagtatt

SEQ ID NO: 123421 - DNA, 25 bp, mus musculus
ttcaatctctccaagaagtattttg

SEQ ID NO: 123422 - DNA, 25 bp, mus musculus
aatctctccaagaagtattttgata

SEQ ID NO: 123423 - DNA, 25 bp, mus musculus
tttcaaaattcctcacaagccagag

SEQ ID NO: 123424 - DNA, 25 bp, mus musculus
tcctcacaagccagagggctcataa

SEQ ID NO: 123425 - DNA, 25 bp, mus musculus
tcacaagccagagggctcataaacc

SEQ ID NO: 123426 - DNA, 25 bp, mus musculus
gggctcataaaccactgcattgtca

SEQ ID NO: 123427 - DNA, 25 bp, mus musculus
ctcataaaccactgcattgtcaaag

SEQ ID NO: 123428 - DNA, 25 bp, mus musculus
aaccactgcattgtcaaagagactg

SEQ ID NO: 123429 - DNA, 25 bp, mus musculus
atcccaagctttttgatgagattaa

SEQ ID NO: 123430 - DNA, 25 bp, mus musculus
ccagccctcttcaagaaggtcaaag

SEQ ID NO: 123431 - DNA, 25 bp, mus musculus
gccctcttcaagaaggtcaaagaga

SEQ ID NO: 123432 - DNA, 25 bp, mus musculus
ctgggcctcagccagggtagctttg

SEQ ID NO: 123433 - DNA, 25 bp, mus musculus
ctcagccagggtagctttgccttca

SEQ ID NO: 123434 - DNA, 25 bp, mus musculus
agctttgccttcatccacaaggact

SEQ ID NO: 123435 - DNA, 25 bp, mus musculus
gccttcatccacaaggactttgata

SEQ ID NO: 123436 - DNA, 25 bp, mus musculus
atccacaaggactttgatatcaaag

SEQ ID NO: 123437 - DNA, 25 bp, mus musculus
gagacctatttcaatctctccaaga

SEQ ID NO: 123438 - DNA, 25 bp, mus musculus
tattctacagctcaagactgcagtg

SEQ ID NO: 123439 - DNA, 25 bp, mus musculus
tctacagctcaagactgcagtgcag

SEQ ID NO: 123440 - DNA, 25 bp, mus musculus
caaagttgtcttacctgtcagtgta

SEQ ID NO: 123441 - DNA, 25 bp, mus musculus
cttacctgtcagtgtatgaagcact

SEQ ID NO: 123442 - DNA, 25 bp, mus musculus
tttgctccttaagacagacaccttg

SEQ ID NO: 123443 - DNA, 25 bp, mus musculus
gctccttaagacagacaccttggaa

SEQ ID NO: 123444 - DNA, 25 bp, mus musculus
gacagacaccttggaactttcattc

SEQ ID NO: 123445 - DNA, 25 bp, mus musculus
ttagtccccgaagtttgagatgagt

SEQ ID NO: 123446 - DNA, 25 bp, mus musculus
gtccccgaagtttgagatgagtctt

SEQ ID NO: 123447 - DNA, 25 bp, mus musculus
ctctgatctgcttaaaatgcagatt

SEQ ID NO: 123448 - DNA, 25 bp, mus musculus
aacacacatatgcaatgttttaagg

SEQ ID NO: 123449 - DNA, 25 bp, mus musculus
tgggatcctaacctaagatgcctta

SEQ ID NO: 123450 - DNA, 25 bp, mus musculus
caagactgcagtgcagatgaagaca

SEQ ID NO: 123451 - DNA, 25 bp, mus musculus
gtacttattctagtgttgctggctt

SEQ ID NO: 123452 - DNA, 25 bp, mus musculus
attggtctcaagcgccatcatactg

SEQ ID NO: 123453 - DNA, 25 bp, mus musculus
ggtctcaagcgccatcatactggat

SEQ ID NO: 123454 - DNA, 25 bp, mus musculus
ctcaagcgccatcatactggatatg

SEQ ID NO: 123455 - DNA, 25 bp, mus musculus
cgccatcatactggatatgagcaat

SEQ ID NO: 123456 - DNA, 25 bp, mus musculus
ttttagtaactgcaatctgattgat

SEQ ID NO: 123457 - DNA, 25 bp, mus musculus
tagtaactgcaatctgattgatcat

SEQ ID NO: 123458 - DNA, 25 bp, mus musculus
gaatggaccgcaccagctcctgagt

SEQ ID NO: 123459 - DNA, 25 bp, mus musculus
accgcaccagctcctgagttcactg

SEQ ID NO: 123460 - DNA, 25 bp, mus musculus
ggagccaccactgagtggtcctgat

SEQ ID NO: 123461 - DNA, 25 bp, mus musculus
gccaccactgagtggtcctgatctg

SEQ ID NO: 123462 - DNA, 25 bp, mus musculus
tgatctgctgtgcaggtgcctgagc

SEQ ID NO: 123463 - DNA, 25 bp, mus musculus
agctgtcttatggtcctcactgcag

SEQ ID NO: 123464 - DNA, 25 bp, mus musculus
atggtcctcactgcagactgtacct

SEQ ID NO: 123465 - DNA, 25 bp, mus musculus
gtcctcactgcagactgtacctgga

SEQ ID NO: 123466 - DNA, 25 bp, mus musculus
ctcactgcagactgtacctggattg

SEQ ID NO: 123467 - DNA, 25 bp, mus musculus
gcagactgtacctggattggcattt

SEQ ID NO: 123468 - DNA, 25 bp, mus musculus
gactgtacctggattggcatttggc

SEQ ID NO: 123469 - DNA, 25 bp, mus musculus
tgtacctggattggcatttggctat

SEQ ID NO: 123470 - DNA, 25 bp, mus musculus
gctcagcctgaggtggccgactggt

SEQ ID NO: 123471 - DNA, 25 bp, mus musculus
cagcctgaggtggccgactggtctg

SEQ ID NO: 123472 - DNA, 25 bp, mus musculus
cagttccccacggaagactggagtg

SEQ ID NO: 123473 - DNA, 25 bp, mus musculus
ttccccacggaagactggagtgcac

SEQ ID NO: 123474 - DNA, 25 bp, mus musculus
gcacagccagccactgaggattggt

SEQ ID NO: 123475 - DNA, 25 bp, mus musculus
cagccagccactgaggattggtcag

SEQ ID NO: 123476 - DNA, 25 bp, mus musculus
acagcgcaggccactgagtgggttg

SEQ ID NO: 123477 - DNA, 25 bp, mus musculus
gccactgagtgggttggagccacca

SEQ ID NO: 123478 - DNA, 25 bp, mus musculus
gctctgctaccatgatctccagccg

SEQ ID NO: 123479 - DNA, 25 bp, mus musculus
ctaccatgatctccagccgctcgga

SEQ ID NO: 123480 - DNA, 25 bp, mus musculus
tgttccggcatctggctgcagcgac

SEQ ID NO: 123481 - DNA, 25 bp, mus musculus
tggctgcagcgactttgttcttttc

SEQ ID NO: 123482 - DNA, 25 bp, mus musculus
tctttctcagtgtcaccgccaggaa

SEQ ID NO: 123483 - DNA, 25 bp, mus musculus
ttctcagtgtcaccgccaggaagtg

SEQ ID NO: 123484 - DNA, 25 bp, mus musculus
tcaccgccaggaagtgcaagggcgc

SEQ ID NO: 123485 - DNA, 25 bp, mus musculus
gcgcagtcatcgcggcaatgttgcg

SEQ ID NO: 123486 - DNA, 25 bp, mus musculus
tcatcgcggcaatgttgcggatgtc

SEQ ID NO: 123487 - DNA, 25 bp, mus musculus
caatgttgcggatgtcagcgtattt

SEQ ID NO: 123488 - DNA, 25 bp, mus musculus
atttcagctcctctgtggtcagagc

SEQ ID NO: 123489 - DNA, 25 bp, mus musculus
tcagctcctctgtggtcagagcaga

SEQ ID NO: 123490 - DNA, 25 bp, mus musculus
gctcggactccctctgcaggaactc

SEQ ID NO: 123491 - DNA, 25 bp, mus musculus
actccctctgcaggaactctgtgcg

SEQ ID NO: 123492 - DNA, 25 bp, mus musculus
tctgcaggaactctgtgcgatcctg

SEQ ID NO: 123493 - DNA, 25 bp, mus musculus
ctgtgcgatcctgctgcttgttccg

SEQ ID NO: 123494 - DNA, 25 bp, mus musculus
tgcgatcctgctgcttgttccggca

SEQ ID NO: 123495 - DNA, 25 bp, mus musculus
gatcctgctgcttgttccggcatct

SEQ ID NO: 123496 - DNA, 25 bp, mus musculus
gctgcttgttccggcatctggctgc

SEQ ID NO: 123497 - DNA, 25 bp, mus musculus
gcttgttccggcatctggctgcagc

SEQ ID NO: 123498 - DNA, 25 bp, mus musculus
gctgctttttgtcttcagaagcttt

SEQ ID NO: 123499 - DNA, 25 bp, mus musculus
taggccacttcgatgtcacctgtat

SEQ ID NO: 123500 - DNA, 25 bp, mus musculus
tagctcttgcgagtataagcccttc

SEQ ID NO: 123501 - DNA, 25 bp, mus musculus
gagtataagcccttcttcccacagc

SEQ ID NO: 123502 - DNA, 25 bp, mus musculus
gtataagcccttcttcccacagcta

SEQ ID NO: 123503 - DNA, 25 bp, mus musculus
tcccacagctaatttgtctaatctc

SEQ ID NO: 123504 - DNA, 25 bp, mus musculus
agctaatttgtctaatctctcatgc

SEQ ID NO: 123505 - DNA, 25 bp, mus musculus
tttgtctaatctctcatgctgactt

SEQ ID NO: 123506 - DNA, 25 bp, mus musculus
tgtctaatctctcatgctgacttta

SEQ ID NO: 123507 - DNA, 25 bp, mus musculus
tctaatctctcatgctgactttata

SEQ ID NO: 123508 - DNA, 25 bp, mus musculus
tgtacacagactacaattggaaaac

SEQ ID NO: 123509 - DNA, 25 bp, mus musculus
tacacagactacaattggaaaactt

SEQ ID NO: 123510 - DNA, 25 bp, mus musculus
acttcgatgtcacctgtataaagga

SEQ ID NO: 123511 - DNA, 25 bp, mus musculus
ttcgatgtcacctgtataaaggaaa

SEQ ID NO: 123512 - DNA, 25 bp, mus musculus
cgatgtcacctgtataaaggaaaat

SEQ ID NO: 123513 - DNA, 25 bp, mus musculus
acttcttttgttgtatcaatcaagt

SEQ ID NO: 123514 - DNA, 25 bp, mus musculus
ggaagattcttcctcttaattgtct

SEQ ID NO: 123515 - DNA, 25 bp, mus musculus
tcctcttaattgtctttgaatatga

SEQ ID NO: 123516 - DNA, 25 bp, mus musculus
atattagctcttgcgagtataagcc

SEQ ID NO: 123517 - DNA, 25 bp, mus musculus
attagctcttgcgagtataagccct

SEQ ID NO: 123518 - DNA, 25 bp, mus musculus
tatgttccatatactgtcatttcat

SEQ ID NO: 123519 - DNA, 25 bp, mus musculus
ccatatactgtcatttcatcactat

SEQ ID NO: 123520 - DNA, 25 bp, mus musculus
ctagttaatgctcttggtcatatcg

SEQ ID NO: 123521 - DNA, 25 bp, mus musculus
aatgctcttggtcatatcgatatat

SEQ ID NO: 123522 - DNA, 25 bp, mus musculus
tggaattcaccatttatgggaaatg

SEQ ID NO: 123523 - DNA, 25 bp, mus musculus
ttgactatggccatttcctatgctt

SEQ ID NO: 123524 - DNA, 25 bp, mus musculus
atggccatttcctatgcttaagacc

SEQ ID NO: 123525 - DNA, 25 bp, mus musculus
atttcctatgcttaagaccatcttt

SEQ ID NO: 123526 - DNA, 25 bp, mus musculus
tatgcttaagaccatctttgacttg

SEQ ID NO: 123527 - DNA, 25 bp, mus musculus
taagaccatctttgacttgcattac

SEQ ID NO: 123528 - DNA, 25 bp, mus musculus
tgacttgcattactgtgtatttatc

SEQ ID NO: 123529 - DNA, 25 bp, mus musculus
tttgtttactcttactgagatataa

SEQ ID NO: 123530 - DNA, 25 bp, mus musculus
actgtcatttcatcactatctctta

SEQ ID NO: 123531 - DNA, 25 bp, mus musculus
atttcatcactatctcttaatgcat

SEQ ID NO: 123532 - DNA, 25 bp, mus musculus
tcactatctcttaatgcatatttaa

SEQ ID NO: 123533 - DNA, 25 bp, mus musculus
gactatttttgtatccacatgggaa

SEQ ID NO: 123534 - DNA, 25 bp, mus musculus
ttttgtatccacatgggaagtagaa

SEQ ID NO: 123535 - DNA, 25 bp, mus musculus
acattgcaagtcagttgctgtctac

SEQ ID NO: 123536 - DNA, 25 bp, mus musculus
caagtcagttgctgtctacacaata

SEQ ID NO: 123537 - DNA, 25 bp, mus musculus
agttgctgtctacacaatagataaa

SEQ ID NO: 123538 - DNA, 25 bp, mus musculus
tctcagtgggagcgcaccggaaagc

SEQ ID NO: 123539 - DNA, 25 bp, mus musculus
tttaggctcatctcagaacaggtca

SEQ ID NO: 123540 - DNA, 25 bp, mus musculus
gcattccatgcagaagggctcaaca

SEQ ID NO: 123541 - DNA, 25 bp, mus musculus
ctcaacaatgacttcatcttccatg

SEQ ID NO: 123542 - DNA, 25 bp, mus musculus
aatgacttcatcttccatggctcaa

SEQ ID NO: 123543 - DNA, 25 bp, mus musculus
gacttcatcttccatggctcaattt

SEQ ID NO: 123544 - DNA, 25 bp, mus musculus
ttcatcttccatggctcaatttacc

SEQ ID NO: 123545 - DNA, 25 bp, mus musculus
atcttccatggctcaatttacccca

SEQ ID NO: 123546 - DNA, 25 bp, mus musculus
catggctcaatttaccccaaactga

SEQ ID NO: 123547 - DNA, 25 bp, mus musculus
aactgaagttctggggcaagagtgt

SEQ ID NO: 123548 - DNA, 25 bp, mus musculus
actgaagttctggggcaagagtgta

SEQ ID NO: 123549 - DNA, 25 bp, mus musculus
ctgaagttctggggcaagagtgtag

SEQ ID NO: 123550 - DNA, 25 bp, mus musculus
aggctcatctcagaacaggtcagcc

SEQ ID NO: 123551 - DNA, 25 bp, mus musculus
ctcatctcagaacaggtcagccatc

SEQ ID NO: 123552 - DNA, 25 bp, mus musculus
atctcagaacaggtcagccatcatc

SEQ ID NO: 123553 - DNA, 25 bp, mus musculus
tcagaacaggtcagccatcatcccc

SEQ ID NO: 123554 - DNA, 25 bp, mus musculus
cccccaatcagtgcattccatgcag

SEQ ID NO: 123555 - DNA, 25 bp, mus musculus
ccaatcagtgcattccatgcagaag

SEQ ID NO: 123556 - DNA, 25 bp, mus musculus
atcagtgcattccatgcagaagggc

SEQ ID NO: 123557 - DNA, 25 bp, mus musculus
agtgcattccatgcagaagggctca

SEQ ID NO: 123558 - DNA, 25 bp, mus musculus
aactatctctgtgatcccacatgca

SEQ ID NO: 123559 - DNA, 25 bp, mus musculus
ctctgtgatcccacatgcacataag

SEQ ID NO: 123560 - DNA, 25 bp, mus musculus
acctgttgccctgaatgtcattcca

SEQ ID NO: 123561 - DNA, 25 bp, mus musculus
tgccctgaatgtcattccagcatct

SEQ ID NO: 123562 - DNA, 25 bp, mus musculus
agcatctgagaaggcctggtgtcat

SEQ ID NO: 123563 - DNA, 25 bp, mus musculus
tgccactcagtaccccatgcagggt

SEQ ID NO: 123564 - DNA, 25 bp, mus musculus
tcagtaccccatgcagggtcccctg

SEQ ID NO: 123565 - DNA, 25 bp, mus musculus
gaacctgcctacatctggcacagtt

SEQ ID NO: 123566 - DNA, 25 bp, mus musculus
ccaaactcctgcagctgcatgggac

SEQ ID NO: 123567 - DNA, 25 bp, mus musculus
tcctgcagctgcatgggactgaggg

SEQ ID NO: 123568 - DNA, 25 bp, mus musculus
agctgcatgggactgagggtcagac

SEQ ID NO: 123569 - DNA, 25 bp, mus musculus
agcctctctctaagatcccagctga

SEQ ID NO: 123570 - DNA, 25 bp, mus musculus
acatgcacataagactttggactct

SEQ ID NO: 123571 - DNA, 25 bp, mus musculus
gactttggactctcagtgtcaggct

SEQ ID NO: 123572 - DNA, 25 bp, mus musculus
ggactctcagtgtcaggctctcggt

SEQ ID NO: 123573 - DNA, 25 bp, mus musculus
tgcatatttctgaacctggaatctg

SEQ ID NO: 123574 - DNA, 25 bp, mus musculus
gggtgactcctctttatgtgtctgt

SEQ ID NO: 123575 - DNA, 25 bp, mus musculus
ccgaccttgagcacatctgcttgca

SEQ ID NO: 123576 - DNA, 25 bp, mus musculus
gcttgcacagtcttgatgggaccat

SEQ ID NO: 123577 - DNA, 25 bp, mus musculus
acagtcttgatgggaccatgctggc

SEQ ID NO: 123578 - DNA, 25 bp, mus musculus
ccgtggcttgttcaccacggttgtg

SEQ ID NO: 123579 - DNA, 25 bp, mus musculus
atcatcccaagaagcatacagatcc

SEQ ID NO: 123580 - DNA, 25 bp, mus musculus
agacatgtcctacagcaaccgcaag

SEQ ID NO: 123581 - DNA, 25 bp, mus musculus
gtcctacagcaaccgcaagacgcca

SEQ ID NO: 123582 - DNA, 25 bp, mus musculus
cccccgtgccttgtttcagcagagc

SEQ ID NO: 123583 - DNA, 25 bp, mus musculus
tgccttgtttcagcagagcttacag

SEQ ID NO: 123584 - DNA, 25 bp, mus musculus
gtttcagcagagcttacagcagtcc

SEQ ID NO: 123585 - DNA, 25 bp, mus musculus
cagcactcttcctgtggtactcaaa

SEQ ID NO: 123586 - DNA, 25 bp, mus musculus
tctgcaatctgtcaccaaccctagc

SEQ ID NO: 123587 - DNA, 25 bp, mus musculus
ccctagccaggtaccctgacatcag

SEQ ID NO: 123588 - DNA, 25 bp, mus musculus
ccaggtaccctgacatcagaaacaa

SEQ ID NO: 123589 - DNA, 25 bp, mus musculus
accctgacatcagaaacaaagcttg

SEQ ID NO: 123590 - DNA, 25 bp, mus musculus
cagatcccaggaacctctgcagaca

SEQ ID NO: 123591 - DNA, 25 bp, mus musculus
ccaggaacctctgcagacatcattt

SEQ ID NO: 123592 - DNA, 25 bp, mus musculus
acctctgcagacatcattttccttc

SEQ ID NO: 123593 - DNA, 25 bp, mus musculus
gcagacatcattttccttcccagct

SEQ ID NO: 123594 - DNA, 25 bp, mus musculus
atcattttccttcccagctgccatt

SEQ ID NO: 123595 - DNA, 25 bp, mus musculus
cccagctgccattgctgtaggcttc

SEQ ID NO: 123596 - DNA, 25 bp, mus musculus
cttcttcaccgggctgctccttggg

SEQ ID NO: 123597 - DNA, 25 bp, mus musculus
ggaatctccgtgcgtagtgtatgaa

SEQ ID NO: 123598 - DNA, 25 bp, mus musculus
cccatcctgtccaacataaagctga

SEQ ID NO: 123599 - DNA, 25 bp, mus musculus
gagcagcgcataaccacgacttccc

SEQ ID NO: 123600 - DNA, 25 bp, mus musculus
ctgcccatgaacgagacagatcacc

SEQ ID NO: 123601 - DNA, 25 bp, mus musculus
gagacagatcacctcaacatggtct

SEQ ID NO: 123602 - DNA, 25 bp, mus musculus
gatcacctcaacatggtcttcagca

SEQ ID NO: 123603 - DNA, 25 bp, mus musculus
ctcaacatggtcttcagcaataaga

SEQ ID NO: 123604 - DNA, 25 bp, mus musculus
gagcatatcaatgccatcctactgg

SEQ ID NO: 123605 - DNA, 25 bp, mus musculus
atcaatgccatcctactgggtgcct

SEQ ID NO: 123606 - DNA, 25 bp, mus musculus
gccatcctactgggtgcctaccgca

SEQ ID NO: 123607 - DNA, 25 bp, mus musculus
ggtgcctaccgcactcctaagtcgc

SEQ ID NO: 123608 - DNA, 25 bp, mus musculus
taccgcactcctaagtcgccagctg

SEQ ID NO: 123609 - DNA, 25 bp, mus musculus
aagtcgccagctgccagcccaagtc

SEQ ID NO: 123610 - DNA, 25 bp, mus musculus
cctcacgtgtggcctgaagaccatg

SEQ ID NO: 123611 - DNA, 25 bp, mus musculus
cgttttttcacagatctgcattttg

SEQ ID NO: 123612 - DNA, 25 bp, mus musculus
ttcacagatctgcattttgaagaag

SEQ ID NO: 123613 - DNA, 25 bp, mus musculus
ggctggcacatgtttcttcagtctc

SEQ ID NO: 123614 - DNA, 25 bp, mus musculus
cacatgtttcttcagtctcgtgacc

SEQ ID NO: 123615 - DNA, 25 bp, mus musculus
atctatgaccacaacttcccctaca

SEQ ID NO: 123616 - DNA, 25 bp, mus musculus
gctgcactctatgaagatggggacg

SEQ ID NO: 123617 - DNA, 25 bp, mus musculus
tcgcagcccgtacatttgctgccca

SEQ ID NO: 123618 - DNA, 25 bp, mus musculus
tacgagctgccgtgggttgaaaaat

SEQ ID NO: 123619 - DNA, 25 bp, mus musculus
tacagaccattgaagctcaacgaaa

SEQ ID NO: 123620 - DNA, 25 bp, mus musculus
ggcaagacaaccagcatcctctgct

SEQ ID NO: 123621 - DNA, 25 bp, mus musculus
aagacaaccagcatcctctgcttgg

SEQ ID NO: 123622 - DNA, 25 bp, mus musculus
accagcatcctctgcttggctcgag

SEQ ID NO: 123623 - DNA, 25 bp, mus musculus
agcatcctctgcttggctcgagcct

SEQ ID NO: 123624 - DNA, 25 bp, mus musculus
tgcttggctcgagccttgctgggcc

SEQ ID NO: 123625 - DNA, 25 bp, mus musculus
cccgccgtgaaggacgcagtctgga

SEQ ID NO: 123626 - DNA, 25 bp, mus musculus
gtctggaactcaatgcctcaaatga

SEQ ID NO: 123627 - DNA, 25 bp, mus musculus
aactcaatgcctcaaatgacagggg

SEQ ID NO: 123628 - DNA, 25 bp, mus musculus
tcaatgcctcaaatgacaggggcat

SEQ ID NO: 123629 - DNA, 25 bp, mus musculus
atgcctcaaatgacaggggcatcga

SEQ ID NO: 123630 - DNA, 25 bp, mus musculus
actgtgagcaggctggaggtctttg

SEQ ID NO: 123631 - DNA, 25 bp, mus musculus
tcaaaatgttcgcccagcagaaagt

SEQ ID NO: 123632 - DNA, 25 bp, mus musculus
aatgtgcccaatatcatcattgctg

SEQ ID NO: 123633 - DNA, 25 bp, mus musculus
gtgcccaatatcatcattgctggtc

SEQ ID NO: 123634 - DNA, 25 bp, mus musculus
cccaatatcatcattgctggtcccc

SEQ ID NO: 123635 - DNA, 25 bp, mus musculus
atcatcattgctggtcccccaggaa

SEQ ID NO: 123636 - DNA, 25 bp, mus musculus
atcattgctggtcccccaggaactg

SEQ ID NO: 123637 - DNA, 25 bp, mus musculus
attgctggtcccccaggaactggca

SEQ ID NO: 123638 - DNA, 25 bp, mus musculus
actggcaagacaaccagcatcctct

SEQ ID NO: 123639 - DNA, 25 bp, mus musculus
ctgcataggcctagggctccattct

SEQ ID NO: 123640 - DNA, 25 bp, mus musculus
aggcctagggctccattctgccgta

SEQ ID NO: 123641 - DNA, 25 bp, mus musculus
ccagccatttgaacctggacagatg

SEQ ID NO: 123642 - DNA, 25 bp, mus musculus
atttgaacctggacagatgcagctg

SEQ ID NO: 123643 - DNA, 25 bp, mus musculus
aagtggtctatctcaactgtaaggc

SEQ ID NO: 123644 - DNA, 25 bp, mus musculus
tggtctatctcaactgtaaggccca

SEQ ID NO: 123645 - DNA, 25 bp, mus musculus
atcccctcttaaccatgaccagcgg

SEQ ID NO: 123646 - DNA, 25 bp, mus musculus
tcttaaccatgaccagcggaacatg

SEQ ID NO: 123647 - DNA, 25 bp, mus musculus
taaccatgaccagcggaacatggtg

SEQ ID NO: 123648 - DNA, 25 bp, mus musculus
ccatgaccagcggaacatggtgtgt

SEQ ID NO: 123649 - DNA, 25 bp, mus musculus
ccagcggaacatggtgtgtgtgacc

SEQ ID NO: 123650 - DNA, 25 bp, mus musculus
tgaagaatctgcccatcaaggtggg

SEQ ID NO: 123651 - DNA, 25 bp, mus musculus
agggctccattctgccgtatattga

SEQ ID NO: 123652 - DNA, 25 bp, mus musculus
gctccattctgccgtatattgaaga

SEQ ID NO: 123653 - DNA, 25 bp, mus musculus
tggcacacacacttgaacaaaagca

SEQ ID NO: 123654 - DNA, 25 bp, mus musculus
cacacacacttgaacaaaagcaagc

SEQ ID NO: 123655 - DNA, 25 bp, mus musculus
agcaagccctcagtgtttccagcca

SEQ ID NO: 123656 - DNA, 25 bp, mus musculus
aagccctcagtgtttccagccattt

SEQ ID NO: 123657 - DNA, 25 bp, mus musculus
gtgtttccagccatttgaacctgga

SEQ ID NO: 123658 - DNA, 25 bp, mus musculus
tttccagccatttgaacctggacag

SEQ ID NO: 123659 - DNA, 25 bp, mus musculus
tgatgccctgtctgactgactggag

SEQ ID NO: 123660 - DNA, 25 bp, mus musculus
atgccctgtctgactgactggagtc

SEQ ID NO: 123661 - DNA, 25 bp, mus musculus
attcagtagctggttgccctgtccc

SEQ ID NO: 123662 - DNA, 25 bp, mus musculus
tcagtagctggttgccctgtccctg

SEQ ID NO: 123663 - DNA, 25 bp, mus musculus
gttgccctgtccctgcatgaatgca

SEQ ID NO: 123664 - DNA, 25 bp, mus musculus
ccctgtccctgcatgaatgcatctg

SEQ ID NO: 123665 - DNA, 25 bp, mus musculus
ctgtccctgcatgaatgcatctgtt

SEQ ID NO: 123666 - DNA, 25 bp, mus musculus
ccctgcatgaatgcatctgttcgtc

SEQ ID NO: 123667 - DNA, 25 bp, mus musculus
atgaatgcatctgttcgtcttacat

SEQ ID NO: 123668 - DNA, 25 bp, mus musculus
gaatgcatctgttcgtcttacatgc

SEQ ID NO: 123669 - DNA, 25 bp, mus musculus
atgcatctgttcgtcttacatgctg

SEQ ID NO: 123670 - DNA, 25 bp, mus musculus
atctgttcgtcttacatgctgatgc

SEQ ID NO: 123671 - DNA, 25 bp, mus musculus
tgtctgactgactggagtcgaatat

SEQ ID NO: 123672 - DNA, 25 bp, mus musculus
tctgttcgtcttacatgctgatgcc

SEQ ID NO: 123673 - DNA, 25 bp, mus musculus
tctgactgactggagtcgaatatcg

SEQ ID NO: 123674 - DNA, 25 bp, mus musculus
tatcgtttatgtgggctcagctgag

SEQ ID NO: 123675 - DNA, 25 bp, mus musculus
tcgtttatgtgggctcagctgagag

SEQ ID NO: 123676 - DNA, 25 bp, mus musculus
ttatgtgggctcagctgagagtgac

SEQ ID NO: 123677 - DNA, 25 bp, mus musculus
atgtgggctcagctgagagtgacga

SEQ ID NO: 123678 - DNA, 25 bp, mus musculus
gatcctagattcagtagctggttgc

SEQ ID NO: 123679 - DNA, 25 bp, mus musculus
ctagattcagtagctggttgccctg

SEQ ID NO: 123680 - DNA, 25 bp, mus musculus
ccagcactccagctttctttgccga

SEQ ID NO: 123681 - DNA, 25 bp, mus musculus
ctttctttgccgagaagctgtacga

SEQ ID NO: 123682 - DNA, 25 bp, mus musculus
catcccaactattctgcaaggttct

SEQ ID NO: 123683 - DNA, 25 bp, mus musculus
aactattctgcaaggttctgaggag

SEQ ID NO: 123684 - DNA, 25 bp, mus musculus
gaatgtctcttagctgttgttttcc

SEQ ID NO: 123685 - DNA, 25 bp, mus musculus
gctgttgttttccttcgatggcatg

SEQ ID NO: 123686 - DNA, 25 bp, mus musculus
cttcgatggcatgggcttaagtagg

SEQ ID NO: 123687 - DNA, 25 bp, mus musculus
taagtctaattacctgctttgaata

SEQ ID NO: 123688 - DNA, 25 bp, mus musculus
catcattactctgtacaatagagaa

SEQ ID NO: 123689 - DNA, 25 bp, mus musculus
taaagccccataagcaagtcacttt

SEQ ID NO: 123690 - DNA, 25 bp, mus musculus
agcaagtcactttggtaccattcct

SEQ ID NO: 123691 - DNA, 25 bp, mus musculus
tcactttggtaccattcctgagaaa

SEQ ID NO: 123692 - DNA, 25 bp, mus musculus
gtgccggaactcgccataaggcatt

SEQ ID NO: 123693 - DNA, 25 bp, mus musculus
gaactcgccataaggcattgatcag

SEQ ID NO: 123694 - DNA, 25 bp, mus musculus
tggtctcccgttcggaaattgacat

SEQ ID NO: 123695 - DNA, 25 bp, mus musculus
gaatctctctttgccaagccatcct

SEQ ID NO: 123696 - DNA, 25 bp, mus musculus
ctctttgccaagccatcctggatga

SEQ ID NO: 123697 - DNA, 25 bp, mus musculus
ccatcctggatgaaaccaaaggaga

SEQ ID NO: 123698 - DNA, 25 bp, mus musculus
tggctctgtgtggtggaaactagac

SEQ ID NO: 123699 - DNA, 25 bp, mus musculus
actagacatcccaactattctgcaa

SEQ ID NO: 123700 - DNA, 25 bp, mus musculus
ccatgcgacgcgtctacataggacg

SEQ ID NO: 123701 - DNA, 25 bp, mus musculus
cgcgtctacataggacgcctgagct

SEQ ID NO: 123702 - DNA, 25 bp, mus musculus
gctacaacgtccgcgagaaggacat

SEQ ID NO: 123703 - DNA, 25 bp, mus musculus
tacaacgtccgcgagaaggacatcc

SEQ ID NO: 123704 - DNA, 25 bp, mus musculus
caacgtccgcgagaaggacatccag

SEQ ID NO: 123705 - DNA, 25 bp, mus musculus
aggacatccagcgctttttcagcgg

SEQ ID NO: 123706 - DNA, 25 bp, mus musculus
gacatccagcgctttttcagcggct

SEQ ID NO: 123707 - DNA, 25 bp, mus musculus
catccagcgctttttcagcggctac

SEQ ID NO: 123708 - DNA, 25 bp, mus musculus
tccagcgctttttcagcggctacgg

SEQ ID NO: 123709 - DNA, 25 bp, mus musculus
tccgtcgagatcgacctcaaaaatg

SEQ ID NO: 123710 - DNA, 25 bp, mus musculus
tcgagatcgacctcaaaaatgggta

SEQ ID NO: 123711 - DNA, 25 bp, mus musculus
gagatcgacctcaaaaatgggtacg

SEQ ID NO: 123712 - DNA, 25 bp, mus musculus
cgtctacataggacgcctgagctac

SEQ ID NO: 123713 - DNA, 25 bp, mus musculus
tctacataggacgcctgagctacaa

SEQ ID NO: 123714 - DNA, 25 bp, mus musculus
tacataggacgcctgagctacaacg

SEQ ID NO: 123715 - DNA, 25 bp, mus musculus
taggacgcctgagctacaacgtccg

SEQ ID NO: 123716 - DNA, 25 bp, mus musculus
ggacgcctgagctacaacgtccgcg

SEQ ID NO: 123717 - DNA, 25 bp, mus musculus
acgcctgagctacaacgtccgcgag

SEQ ID NO: 123718 - DNA, 25 bp, mus musculus
gcctgagctacaacgtccgcgagaa

SEQ ID NO: 123719 - DNA, 25 bp, mus musculus
gagctacaacgtccgcgagaaggac

SEQ ID NO: 123720 - DNA, 25 bp, mus musculus
agccaagcttttgacctccagctct

SEQ ID NO: 123721 - DNA, 25 bp, mus musculus
ttttgacctccagctctctgttcaa

SEQ ID NO: 123722 - DNA, 25 bp, mus musculus
ggcattgtctccgtcatactcagtg

SEQ ID NO: 123723 - DNA, 25 bp, mus musculus
cattgtctccgtcatactcagtgtc

SEQ ID NO: 123724 - DNA, 25 bp, mus musculus
gtctccgtcatactcagtgtcccct

SEQ ID NO: 123725 - DNA, 25 bp, mus musculus
tactcagtgtcccctgcgactggat

SEQ ID NO: 123726 - DNA, 25 bp, mus musculus
ctcagtgtcccctgcgactggattg

SEQ ID NO: 123727 - DNA, 25 bp, mus musculus
cagtgtcccctgcgactggattgcc

SEQ ID NO: 123728 - DNA, 25 bp, mus musculus
ccgctagcaatctctccacatagat

SEQ ID NO: 123729 - DNA, 25 bp, mus musculus
gctagcaatctctccacatagattg

SEQ ID NO: 123730 - DNA, 25 bp, mus musculus
tagcaatctctccacatagattgtc

SEQ ID NO: 123731 - DNA, 25 bp, mus musculus
gcaatctctccacatagattgtcct

SEQ ID NO: 123732 - DNA, 25 bp, mus musculus
ttgacctccagctctctgttcaaca

SEQ ID NO: 123733 - DNA, 25 bp, mus musculus
caatctctccacatagattgtcctg

SEQ ID NO: 123734 - DNA, 25 bp, mus musculus
cctccagctctctgttcaacagata

SEQ ID NO: 123735 - DNA, 25 bp, mus musculus
tccagctctctgttcaacagatacg

SEQ ID NO: 123736 - DNA, 25 bp, mus musculus
gctctctgttcaacagatacgctgt

SEQ ID NO: 123737 - DNA, 25 bp, mus musculus
gtacaacgtcggctcaagcgctctg

SEQ ID NO: 123738 - DNA, 25 bp, mus musculus
tcggctcaagcgctctgttcgatgt

SEQ ID NO: 123739 - DNA, 25 bp, mus musculus
ctcaagcgctctgttcgatgtgtat

SEQ ID NO: 123740 - DNA, 25 bp, mus musculus
tcggcattgtctccgtcatactcag

SEQ ID NO: 123741 - DNA, 25 bp, mus musculus
attcggcactgaggaggcgcctgcg

SEQ ID NO: 123742 - DNA, 25 bp, mus musculus
cggtgcgcttgtggctggacaacac

SEQ ID NO: 123743 - DNA, 25 bp, mus musculus
aaatgctgatcatgcgtggagcacg

SEQ ID NO: 123744 - DNA, 25 bp, mus musculus
aatgctgatcatgcgtggagcacgg

SEQ ID NO: 123745 - DNA, 25 bp, mus musculus
atgctgatcatgcgtggagcacgga

SEQ ID NO: 123746 - DNA, 25 bp, mus musculus
tgctgatcatgcgtggagcacggat

SEQ ID NO: 123747 - DNA, 25 bp, mus musculus
ctgatcatgcgtggagcacggatta

SEQ ID NO: 123748 - DNA, 25 bp, mus musculus
tgatcatgcgtggagcacggattaa

SEQ ID NO: 123749 - DNA, 25 bp, mus musculus
gatcatgcgtggagcacggattaat

SEQ ID NO: 123750 - DNA, 25 bp, mus musculus
atcatgcgtggagcacggattaatg

SEQ ID NO: 123751 - DNA, 25 bp, mus musculus
tcatgcgtggagcacggattaatgt

SEQ ID NO: 123752 - DNA, 25 bp, mus musculus
ggtgcgcttgtggctggacaacaca

SEQ ID NO: 123753 - DNA, 25 bp, mus musculus
gtgcgcttgtggctggacaacacag

SEQ ID NO: 123754 - DNA, 25 bp, mus musculus
tgcgcttgtggctggacaacacaga

SEQ ID NO: 123755 - DNA, 25 bp, mus musculus
gcgcttgtggctggacaacacagag

SEQ ID NO: 123756 - DNA, 25 bp, mus musculus
aaggccgctctgcggtggttgaaat

SEQ ID NO: 123757 - DNA, 25 bp, mus musculus
aggccgctctgcggtggttgaaatg

SEQ ID NO: 123758 - DNA, 25 bp, mus musculus
ggccgctctgcggtggttgaaatgc

SEQ ID NO: 123759 - DNA, 25 bp, mus musculus
gaaatgctgatcatgcgtggagcac

SEQ ID NO: 123760 - DNA, 25 bp, mus musculus
ctcatgatgctgtgctggaaggagc

SEQ ID NO: 123761 - DNA, 25 bp, mus musculus
atgctgtgctggaaggagcgcccag

SEQ ID NO: 123762 - DNA, 25 bp, mus musculus
tgtgtcacacataatgcagtttctg

SEQ ID NO: 123763 - DNA, 25 bp, mus musculus
acacataatgcagtttctgtctgta

SEQ ID NO: 123764 - DNA, 25 bp, mus musculus
aatgcagtttctgtctgtacacaca

SEQ ID NO: 123765 - DNA, 25 bp, mus musculus
gtctgtacacacatctgtagttatg

SEQ ID NO: 123766 - DNA, 25 bp, mus musculus
tctacacatgtgtcttatacctgtg

SEQ ID NO: 123767 - DNA, 25 bp, mus musculus
ccttggatacctcctaagatgtctc

SEQ ID NO: 123768 - DNA, 25 bp, mus musculus
ttccatttcctgaagccatagagag

SEQ ID NO: 123769 - DNA, 25 bp, mus musculus
atgcgtgtctctgtctaccactgcc

SEQ ID NO: 123770 - DNA, 25 bp, mus musculus
cactgcctttcagagggtctccagg

SEQ ID NO: 123771 - DNA, 25 bp, mus musculus
tctctgtgtgttctgtcctgtgccc

SEQ ID NO: 123772 - DNA, 25 bp, mus musculus
cttcggagtgttctggatgacttct

SEQ ID NO: 123773 - DNA, 25 bp, mus musculus
gtgttctgtcctgtgcccggaattc

SEQ ID NO: 123774 - DNA, 25 bp, mus musculus
tgataggcctttcggtcccaagatc

SEQ ID NO: 123775 - DNA, 25 bp, mus musculus
ttcctgtgccatatctgtgtggcct

SEQ ID NO: 123776 - DNA, 25 bp, mus musculus
atctgtgtggcctgtgcacacatgg

SEQ ID NO: 123777 - DNA, 25 bp, mus musculus
gtggcctgtgcacacatggactctg

SEQ ID NO: 123778 - DNA, 25 bp, mus musculus
cacatggactctgactctgtacatg

SEQ ID NO: 123779 - DNA, 25 bp, mus musculus
gactctgtacatgaaacctgtgcgt

SEQ ID NO: 123780 - DNA, 25 bp, mus musculus
gtacatgaaacctgtgcgtgtgtca

SEQ ID NO: 123781 - DNA, 25 bp, mus musculus
acgttgctggcgtaactctgaagtc

SEQ ID NO: 123782 - DNA, 25 bp, mus musculus
taactctgaagtcactgaacccagc

SEQ ID NO: 123783 - DNA, 25 bp, mus musculus
tcccttgtgtcttgggacaaagtgg

SEQ ID NO: 123784 - DNA, 25 bp, mus musculus
gtatcacagactttgtgaaagtcaa

SEQ ID NO: 123785 - DNA, 25 bp, mus musculus
aagtcaacatgaccgctgaggagga

SEQ ID NO: 123786 - DNA, 25 bp, mus musculus
gtgcggacacactctggaatatgca

SEQ ID NO: 123787 - DNA, 25 bp, mus musculus
acacactctggaatatgcagaagga

SEQ ID NO: 123788 - DNA, 25 bp, mus musculus
gccaccttcgaccgtgtgacagatg

SEQ ID NO: 123789 - DNA, 25 bp, mus musculus
tcacatcactgatcacggcagtccc

SEQ ID NO: 123790 - DNA, 25 bp, mus musculus
cactgatcacggcagtcccactgaa

SEQ ID NO: 123791 - DNA, 25 bp, mus musculus
aagtgtttccacatcataacaaagt

SEQ ID NO: 123792 - DNA, 25 bp, mus musculus
ttccacatcataacaaagttcaata

SEQ ID NO: 123793 - DNA, 25 bp, mus musculus
atacctcttgggctatcgggctgtc

SEQ ID NO: 123794 - DNA, 25 bp, mus musculus
cttgggctatcgggctgtctgtgac

SEQ ID NO: 123795 - DNA, 25 bp, mus musculus
ctatcgggctgtctgtgactgatct

SEQ ID NO: 123796 - DNA, 25 bp, mus musculus
ctgtgactgatctggcgcgatccat

SEQ ID NO: 123797 - DNA, 25 bp, mus musculus
ctgatctggcgcgatccatcttgaa

SEQ ID NO: 123798 - DNA, 25 bp, mus musculus
tggcgcgatccatcttgaagaatct

SEQ ID NO: 123799 - DNA, 25 bp, mus musculus
gatccatcttgaagaatcttaagag

SEQ ID NO: 123800 - DNA, 25 bp, mus musculus
gagtgcatcctgttaccacgctggt

SEQ ID NO: 123801 - DNA, 25 bp, mus musculus
tcctcatccaagtgacggggaccgt

SEQ ID NO: 123802 - DNA, 25 bp, mus musculus
tctccgtctccttcaacagcagcaa

SEQ ID NO: 123803 - DNA, 25 bp, mus musculus
ttccaaatggaagccctccagaaga

SEQ ID NO: 123804 - DNA, 25 bp, mus musculus
atggaagccctccagaagacactga

SEQ ID NO: 123805 - DNA, 25 bp, mus musculus
acactgaccctctggcagtacctgg

SEQ ID NO: 123806 - DNA, 25 bp, mus musculus
tctgatacactgacagcccaggaat

SEQ ID NO: 123807 - DNA, 25 bp, mus musculus
acagcccaggaatagacttgagagc

SEQ ID NO: 123808 - DNA, 25 bp, mus musculus
ctctgaccagcttcagtcacatgcc

SEQ ID NO: 123809 - DNA, 25 bp, mus musculus
acatgccaccgtgtatcctgtcctt

SEQ ID NO: 123810 - DNA, 25 bp, mus musculus
caccgtgtatcctgtccttcactag

SEQ ID NO: 123811 - DNA, 25 bp, mus musculus
gtatcctgtccttcactagtcattg

SEQ ID NO: 123812 - DNA, 25 bp, mus musculus
tgtccttcactagtcattgctgttc

SEQ ID NO: 123813 - DNA, 25 bp, mus musculus
gcagcaagcatttccatttgtatgg

SEQ ID NO: 123814 - DNA, 25 bp, mus musculus
cactagtcattgctgttcctagtcc

SEQ ID NO: 123815 - DNA, 25 bp, mus musculus
agcatttccatttgtatggcagcaa

SEQ ID NO: 123816 - DNA, 25 bp, mus musculus
tccatttgtatggcagcaaagcctc

SEQ ID NO: 123817 - DNA, 25 bp, mus musculus
aagcctctgaggcccaggtcctcgt

SEQ ID NO: 123818 - DNA, 25 bp, mus musculus
ttgacctgatccacgagaaggagat

SEQ ID NO: 123819 - DNA, 25 bp, mus musculus
acgtgtacgtgctcagcggcattgg

SEQ ID NO: 123820 - DNA, 25 bp, mus musculus
acgtgctcagcggcattgggggcct

SEQ ID NO: 123821 - DNA, 25 bp, mus musculus
tggcgctctacaaggttggcttctt

SEQ ID NO: 123822 - DNA, 25 bp, mus musculus
gatgtcgtgttgactctggtaaccg

SEQ ID NO: 123823 - DNA, 25 bp, mus musculus
atgtcgtgttgactctggtaaccgt

SEQ ID NO: 123824 - DNA, 25 bp, mus musculus
cgacctccaaatcattgttcaacat

SEQ ID NO: 123825 - DNA, 25 bp, mus musculus
aacatcggcattgtctcgggtatac

SEQ ID NO: 123826 - DNA, 25 bp, mus musculus
atcggcattgtctcgggtatactcc

SEQ ID NO: 123827 - DNA, 25 bp, mus musculus
gtctcgggtatactccatgtaaaat

SEQ ID NO: 123828 - DNA, 25 bp, mus musculus
tctcgggtatactccatgtaaaatg

SEQ ID NO: 123829 - DNA, 25 bp, mus musculus
cggattgccaccgctaacaatgtta

SEQ ID NO: 123830 - DNA, 25 bp, mus musculus
ggattgccaccgctaacaatgttat

SEQ ID NO: 123831 - DNA, 25 bp, mus musculus
attgccaccgctaacaatgttatcc

SEQ ID NO: 123832 - DNA, 25 bp, mus musculus
gccaccgctaacaatgttatccaga

SEQ ID NO: 123833 - DNA, 25 bp, mus musculus
ccaccgctaacaatgttatccagac

SEQ ID NO: 123834 - DNA, 25 bp, mus musculus
tgactctggtaaccgtcagtcaaac

SEQ ID NO: 123835 - DNA, 25 bp, mus musculus
caccgctaacaatgttatccagaca

SEQ ID NO: 123836 - DNA, 25 bp, mus musculus
gtaaccgtcagtcaaacagaagacg

SEQ ID NO: 123837 - DNA, 25 bp, mus musculus
accgtcagtcaaacagaagacggat

SEQ ID NO: 123838 - DNA, 25 bp, mus musculus
gatacaagctttcgacctccaaatc

SEQ ID NO: 123839 - DNA, 25 bp, mus musculus
tacaagctttcgacctccaaatcat

SEQ ID NO: 123840 - DNA, 25 bp, mus musculus
acaagctttcgacctccaaatcatt

SEQ ID NO: 123841 - DNA, 25 bp, mus musculus
aagctttcgacctccaaatcattgt

SEQ ID NO: 123842 - DNA, 25 bp, mus musculus
agctttcgacctccaaatcattgtt

SEQ ID NO: 123843 - DNA, 25 bp, mus musculus
agctagaactgattctccgacaact

SEQ ID NO: 123844 - DNA, 25 bp, mus musculus
tagaactgattctccgacaactgca

SEQ ID NO: 123845 - DNA, 25 bp, mus musculus
aggtccagcacctgaggcaggacaa

SEQ ID NO: 123846 - DNA, 25 bp, mus musculus
tccagcacctgaggcaggacaacat

SEQ ID NO: 123847 - DNA, 25 bp, mus musculus
aggacaacatgcggctgcaggaaga

SEQ ID NO: 123848 - DNA, 25 bp, mus musculus
agtcacagacagccacagcccagct

SEQ ID NO: 123849 - DNA, 25 bp, mus musculus
agacagccacagcccagctgcgcaa

SEQ ID NO: 123850 - DNA, 25 bp, mus musculus
cagcccagctgcgcaagttcaccga

SEQ ID NO: 123851 - DNA, 25 bp, mus musculus
cccagctgcgcaagttcaccgagtg

SEQ ID NO: 123852 - DNA, 25 bp, mus musculus
tttttagcaccattgacaagaaggc

SEQ ID NO: 123853 - DNA, 25 bp, mus musculus
ttagcaccattgacaagaaggcctg

SEQ ID NO: 123854 - DNA, 25 bp, mus musculus
aggcctgatcagctcgctgctcctc

SEQ ID NO: 123855 - DNA, 25 bp, mus musculus
tgattctccgacaactgcagactga

SEQ ID NO: 123856 - DNA, 25 bp, mus musculus
ttctccgacaactgcagactgacct

SEQ ID NO: 123857 - DNA, 25 bp, mus musculus
tccgacaactgcagactgaccttcg

SEQ ID NO: 123858 - DNA, 25 bp, mus musculus
gacaactgcagactgaccttcggaa

SEQ ID NO: 123859 - DNA, 25 bp, mus musculus
cggtgctgcaggctgaggtccagca

SEQ ID NO: 123860 - DNA, 25 bp, mus musculus
tgctgcaggctgaggtccagcacct

SEQ ID NO: 123861 - DNA, 25 bp, mus musculus
aggctgaggtccagcacctgaggca

SEQ ID NO: 123862 - DNA, 25 bp, mus musculus
ctgaggtccagcacctgaggcagga

SEQ ID NO: 123863 - DNA, 25 bp, mus musculus
acctccaaagaacagtgctctattc

SEQ ID NO: 123864 - DNA, 25 bp, mus musculus
cagtgctctattcaagttgggaaag

SEQ ID NO: 123865 - DNA, 25 bp, mus musculus
ctctgatggttccttgaagtcagtg

SEQ ID NO: 123866 - DNA, 25 bp, mus musculus
ccactctcttggagctgatgttatg

SEQ ID NO: 123867 - DNA, 25 bp, mus musculus
aattcctgggctcaggctggagtga

SEQ ID NO: 123868 - DNA, 25 bp, mus musculus
ttccctaacatcttctactcagata

SEQ ID NO: 123869 - DNA, 25 bp, mus musculus
aacatcttctactcagatacctaaa

SEQ ID NO: 123870 - DNA, 25 bp, mus musculus
ggacagctgtccccaactcttacca

SEQ ID NO: 123871 - DNA, 25 bp, mus musculus
ccaacctgtaggctatctcattttc

SEQ ID NO: 123872 - DNA, 25 bp, mus musculus
cattttctcgcttcactctgcaagg

SEQ ID NO: 123873 - DNA, 25 bp, mus musculus
ctcgcttcactctgcaaggtttata

SEQ ID NO: 123874 - DNA, 25 bp, mus musculus
tcactctgcaaggtttataacatga

SEQ ID NO: 123875 - DNA, 25 bp, mus musculus
gtcctacttcctctgtagacccact

SEQ ID NO: 123876 - DNA, 25 bp, mus musculus
cttcctctgtagacccactatctgt

SEQ ID NO: 123877 - DNA, 25 bp, mus musculus
tgagtgacagccactgtagctgttc

SEQ ID NO: 123878 - DNA, 25 bp, mus musculus
acagccactgtagctgttcacatta

SEQ ID NO: 123879 - DNA, 25 bp, mus musculus
actgtagctgttcacattaaccttc

SEQ ID NO: 123880 - DNA, 25 bp, mus musculus
atggccaccaaacatcaaagaaggg

SEQ ID NO: 123881 - DNA, 25 bp, mus musculus
ctcctgcattgagttttagttttga

SEQ ID NO: 123882 - DNA, 25 bp, mus musculus
cccttctctttattagatctctgat

SEQ ID NO: 123883 - DNA, 25 bp, mus musculus
aagtgttactcttgttgtctacacg

SEQ ID NO: 123884 - DNA, 25 bp, mus musculus
agtgttactcttgttgtctacacgg

SEQ ID NO: 123885 - DNA, 25 bp, mus musculus
tgtctacacggacgatcccttgcca

SEQ ID NO: 123886 - DNA, 25 bp, mus musculus
gtctacacggacgatcccttgccag

SEQ ID NO: 123887 - DNA, 25 bp, mus musculus
tctacacggacgatcccttgccagt

SEQ ID NO: 123888 - DNA, 25 bp, mus musculus
ctacacggacgatcccttgccagtt

SEQ ID NO: 123889 - DNA, 25 bp, mus musculus
acacggacgatcccttgccagttgt

SEQ ID NO: 123890 - DNA, 25 bp, mus musculus
cacggacgatcccttgccagttgta

SEQ ID NO: 123891 - DNA, 25 bp, mus musculus
cggacgatcccttgccagttgtaag

SEQ ID NO: 123892 - DNA, 25 bp, mus musculus
gacgatcccttgccagttgtaagtc

SEQ ID NO: 123893 - DNA, 25 bp, mus musculus
gatcccttgccagttgtaagtccct

SEQ ID NO: 123894 - DNA, 25 bp, mus musculus
tcccttgccagttgtaagtccctgg

SEQ ID NO: 123895 - DNA, 25 bp, mus musculus
gtgttactcttgttgtctacacgga

SEQ ID NO: 123896 - DNA, 25 bp, mus musculus
tgttactcttgttgtctacacggac

SEQ ID NO: 123897 - DNA, 25 bp, mus musculus
ttactcttgttgtctacacggacga

SEQ ID NO: 123898 - DNA, 25 bp, mus musculus
tactcttgttgtctacacggacgat

SEQ ID NO: 123899 - DNA, 25 bp, mus musculus
actcttgttgtctacacggacgatc

SEQ ID NO: 123900 - DNA, 25 bp, mus musculus
ctcttgttgtctacacggacgatcc

SEQ ID NO: 123901 - DNA, 25 bp, mus musculus
cttgttgtctacacggacgatccct

SEQ ID NO: 123902 - DNA, 25 bp, mus musculus
ttgttgtctacacggacgatccctt

SEQ ID NO: 123903 - DNA, 25 bp, mus musculus
aattttctgcatgtaccttcaactc

SEQ ID NO: 123904 - DNA, 25 bp, mus musculus
gctttccaagatcaagtaagccttc

SEQ ID NO: 123905 - DNA, 25 bp, mus musculus
tttcacttcaatctgtgattcatgt

SEQ ID NO: 123906 - DNA, 25 bp, mus musculus
cacttcaatctgtgattcatgttgc

SEQ ID NO: 123907 - DNA, 25 bp, mus musculus
atatattcataacagactggaaatt

SEQ ID NO: 123908 - DNA, 25 bp, mus musculus
tattcataacagactggaaatttaa

SEQ ID NO: 123909 - DNA, 25 bp, mus musculus
tctttgtcctcagatagtttgataa

SEQ ID NO: 123910 - DNA, 25 bp, mus musculus
ttgtcctcagatagtttgataaata

SEQ ID NO: 123911 - DNA, 25 bp, mus musculus
agatgcactgtgcagcgtgatagct

SEQ ID NO: 123912 - DNA, 25 bp, mus musculus
tgcactgtgcagcgtgatagctgtt

SEQ ID NO: 123913 - DNA, 25 bp, mus musculus
actgtgcagcgtgatagctgttagc

SEQ ID NO: 123914 - DNA, 25 bp, mus musculus
gatagctgttagccttacatggtaa

SEQ ID NO: 123915 - DNA, 25 bp, mus musculus
gatcaagtaagccttcccaggctgc

SEQ ID NO: 123916 - DNA, 25 bp, mus musculus
caagtaagccttcccaggctgccct

SEQ ID NO: 123917 - DNA, 25 bp, mus musculus
aggctgccctgaagttatccatagt

SEQ ID NO: 123918 - DNA, 25 bp, mus musculus
agttatccatagtgcactgtcaaca

SEQ ID NO: 123919 - DNA, 25 bp, mus musculus
ctttaagcacttcaggtgaattgaa

SEQ ID NO: 123920 - DNA, 25 bp, mus musculus
ctgcttcaaagggtggcccaagaca

SEQ ID NO: 123921 - DNA, 25 bp, mus musculus
gcccaagacacttggtgacataaat

SEQ ID NO: 123922 - DNA, 25 bp, mus musculus
gatctttttcacttcaatctgtgat

SEQ ID NO: 123923 - DNA, 25 bp, mus musculus
ggaactgttcccttgctccatggag

SEQ ID NO: 123924 - DNA, 25 bp, mus musculus
gttcccttgctccatggagaacaag

SEQ ID NO: 123925 - DNA, 25 bp, mus musculus
actatccttcttgtgactcctagtt

SEQ ID NO: 123926 - DNA, 25 bp, mus musculus
tgctaagtcctcaagctgctatgtt

SEQ ID NO: 123927 - DNA, 25 bp, mus musculus
gtcctcaagctgctatgttttatgg

SEQ ID NO: 123928 - DNA, 25 bp, mus musculus
aagctgctatgttttatggggtctg

SEQ ID NO: 123929 - DNA, 25 bp, mus musculus
gggtcccttccatgactttctcttg

SEQ ID NO: 123930 - DNA, 25 bp, mus musculus
tgactttctcttgtctttaactgga

SEQ ID NO: 123931 - DNA, 25 bp, mus musculus
tctcttgtctttaactggacttggt

SEQ ID NO: 123932 - DNA, 25 bp, mus musculus
tatttattctgagcatagctcagac

SEQ ID NO: 123933 - DNA, 25 bp, mus musculus
gcatagctcagacaagactttatat

SEQ ID NO: 123934 - DNA, 25 bp, mus musculus
actgctgggcagctgctagataaaa

SEQ ID NO: 123935 - DNA, 25 bp, mus musculus
gagtcaactgttgctcctgaaggct

SEQ ID NO: 123936 - DNA, 25 bp, mus musculus
actgttgctcctgaaggctggccac

SEQ ID NO: 123937 - DNA, 25 bp, mus musculus
gcatggagcccaggatgcatacaga

SEQ ID NO: 123938 - DNA, 25 bp, mus musculus
agcccaggatgcatacagagactgg

SEQ ID NO: 123939 - DNA, 25 bp, mus musculus
atacagagactgggagctgtcttat

SEQ ID NO: 123940 - DNA, 25 bp, mus musculus
ggagctgtcttatcccaacaccacc

SEQ ID NO: 123941 - DNA, 25 bp, mus musculus
caccaccagctttggactctttctt

SEQ ID NO: 123942 - DNA, 25 bp, mus musculus
atgagaactatccttcttgtgactc

SEQ ID NO: 123943 - DNA, 25 bp, mus musculus
acagaatcgcactgttcctaggcca

SEQ ID NO: 123944 - DNA, 25 bp, mus musculus
tcgcactgttcctaggccatagtcc

SEQ ID NO: 123945 - DNA, 25 bp, mus musculus
gctgctcgcaatggtcgcactgctg

SEQ ID NO: 123946 - DNA, 25 bp, mus musculus
gctcgcaatggtcgcactgctggtc

SEQ ID NO: 123947 - DNA, 25 bp, mus musculus
cgcaatggtcgcactgctggtcacc

SEQ ID NO: 123948 - DNA, 25 bp, mus musculus
gctggtcaccatctgtagcctggaa

SEQ ID NO: 123949 - DNA, 25 bp, mus musculus
ggtcaccatctgtagcctggaagga

SEQ ID NO: 123950 - DNA, 25 bp, mus musculus
agacggaccggatatgcagagcctg

SEQ ID NO: 123951 - DNA, 25 bp, mus musculus
tatgcagagcctgttcactcaatac

SEQ ID NO: 123952 - DNA, 25 bp, mus musculus
agatgccgagacctcatagattcag

SEQ ID NO: 123953 - DNA, 25 bp, mus musculus
atactttgagaagacccgcgagcag

SEQ ID NO: 123954 - DNA, 25 bp, mus musculus
tgagaagacccgcgagcagctggcc

SEQ ID NO: 123955 - DNA, 25 bp, mus musculus
tcctaggccatagtccgccatcatg

SEQ ID NO: 123956 - DNA, 25 bp, mus musculus
taggccatagtccgccatcatgaag

SEQ ID NO: 123957 - DNA, 25 bp, mus musculus
gccatagtccgccatcatgaagctg

SEQ ID NO: 123958 - DNA, 25 bp, mus musculus
atagtccgccatcatgaagctgctc

SEQ ID NO: 123959 - DNA, 25 bp, mus musculus
gtccgccatcatgaagctgctcgca

SEQ ID NO: 123960 - DNA, 25 bp, mus musculus
catcatgaagctgctcgcaatggtc

SEQ ID NO: 123961 - DNA, 25 bp, mus musculus
catgaagctgctcgcaatggtcgca

SEQ ID NO: 123962 - DNA, 25 bp, mus musculus
gaagctgctcgcaatggtcgcactg

SEQ ID NO: 123963 - DNA, 25 bp, mus musculus
ataactgtgggcaagcctgtgaagg

SEQ ID NO: 123964 - DNA, 25 bp, mus musculus
actgtgggcaagcctgtgaagggtc

SEQ ID NO: 123965 - DNA, 25 bp, mus musculus
taacaggacccaggtctccctctag

SEQ ID NO: 123966 - DNA, 25 bp, mus musculus
ctccctctagggcaggatggcccag

SEQ ID NO: 123967 - DNA, 25 bp, mus musculus
cctctagggcaggatggcccaggac

SEQ ID NO: 123968 - DNA, 25 bp, mus musculus
ctagggcaggatggcccaggacctc

SEQ ID NO: 123969 - DNA, 25 bp, mus musculus
ggcccaggacctcagtgagaaggag

SEQ ID NO: 123970 - DNA, 25 bp, mus musculus
ccaggacctcagtgagaaggagctg

SEQ ID NO: 123971 - DNA, 25 bp, mus musculus
gaagaacccacgtgatctgatttcc

SEQ ID NO: 123972 - DNA, 25 bp, mus musculus
cccacgtgatctgatttccaagaca

SEQ ID NO: 123973 - DNA, 25 bp, mus musculus
tgatctgatttccaagacaggaaag

SEQ ID NO: 123974 - DNA, 25 bp, mus musculus
tctgatttccaagacaggaaaggaa

SEQ ID NO: 123975 - DNA, 25 bp, mus musculus
atttctcagctgatgaggcgctagg

SEQ ID NO: 123976 - DNA, 25 bp, mus musculus
tctcagctgatgaggcgctaggaag

SEQ ID NO: 123977 - DNA, 25 bp, mus musculus
cagctgatgaggcgctaggaagttc

SEQ ID NO: 123978 - DNA, 25 bp, mus musculus
gaagttcaaacaccattgtgtctgg

SEQ ID NO: 123979 - DNA, 25 bp, mus musculus
caaacaccattgtgtctgggtcctg

SEQ ID NO: 123980 - DNA, 25 bp, mus musculus
acaccattgtgtctgggtcctggac

SEQ ID NO: 123981 - DNA, 25 bp, mus musculus
ctgggtcctggaccggtgatctgga

SEQ ID NO: 123982 - DNA, 25 bp, mus musculus
cctggaccggtgatctggagagagc

SEQ ID NO: 123983 - DNA, 25 bp, mus musculus
tcggatccatggcttacgaccaact

SEQ ID NO: 123984 - DNA, 25 bp, mus musculus
gatccatggcttacgaccaactcaa

SEQ ID NO: 123985 - DNA, 25 bp, mus musculus
tgagccgtgacagttgtcagcccct

SEQ ID NO: 123986 - DNA, 25 bp, mus musculus
gtgacagttgtcagccccttggagc

SEQ ID NO: 123987 - DNA, 25 bp, mus musculus
cggaccaagctgcaggctcagcatg

SEQ ID NO: 123988 - DNA, 25 bp, mus musculus
aagctgcaggctcagcatgtgtcat

SEQ ID NO: 123989 - DNA, 25 bp, mus musculus
cagcatgtgtcataccgtgagctgg

SEQ ID NO: 123990 - DNA, 25 bp, mus musculus
catgtgtcataccgtgagctggctt

SEQ ID NO: 123991 - DNA, 25 bp, mus musculus
gcttcctctgttcaagctgcggtga

SEQ ID NO: 123992 - DNA, 25 bp, mus musculus
cttcgagatgtccccttctcagctc

SEQ ID NO: 123993 - DNA, 25 bp, mus musculus
cccttctcagctctgtactggttca

SEQ ID NO: 123994 - DNA, 25 bp, mus musculus
tcagctctgtactggttcaactacg

SEQ ID NO: 123995 - DNA, 25 bp, mus musculus
tggcttacgaccaactcaaggcctt

SEQ ID NO: 123996 - DNA, 25 bp, mus musculus
ctgtactggttcaactacgagttgg

SEQ ID NO: 123997 - DNA, 25 bp, mus musculus
acgaccaactcaaggccttcctgtg

SEQ ID NO: 123998 - DNA, 25 bp, mus musculus
aactcaaggccttcctgtgtggtca

SEQ ID NO: 123999 - DNA, 25 bp, mus musculus
aggccttcctgtgtggtcagtcctt

SEQ ID NO: 124000 - DNA, 25 bp, mus musculus
gtggtcagtccttgacctctgacct

SEQ ID NO: 124001 - DNA, 25 bp, mus musculus
acctctacgcacccatggtggctgg

SEQ ID NO: 124002 - DNA, 25 bp, mus musculus
tctacgcacccatggtggctggtgc

SEQ ID NO: 124003 - DNA, 25 bp, mus musculus
cccgaatgagccgtgacagttgtca

SEQ ID NO: 124004 - DNA, 25 bp, mus musculus
tggaacactattccattgtcaattt

SEQ ID NO: 124005 - DNA, 25 bp, mus musculus
tttatcacctagctaatcaactttt

SEQ ID NO: 124006 - DNA, 25 bp, mus musculus
acaacattgcctcacagccctgctt

SEQ ID NO: 124007 - DNA, 25 bp, mus musculus
acattgcctcacagccctgcttaca

SEQ ID NO: 124008 - DNA, 25 bp, mus musculus
cacagccctgcttacattaagaagt

SEQ ID NO: 124009 - DNA, 25 bp, mus musculus
agccctgcttacattaagaagtctc

SEQ ID NO: 124010 - DNA, 25 bp, mus musculus
ctttctcctagctgttctgactgga

SEQ ID NO: 124011 - DNA, 25 bp, mus musculus
tctcctagctgttctgactggattt

SEQ ID NO: 124012 - DNA, 25 bp, mus musculus
agctgttctgactggatttttctcc

SEQ ID NO: 124013 - DNA, 25 bp, mus musculus
ctatagaaaatacctccgttctcat

SEQ ID NO: 124014 - DNA, 25 bp, mus musculus
atacctccgttctcatttgctgcta

SEQ ID NO: 124015 - DNA, 25 bp, mus musculus
cctccgttctcatttgctgctattc

SEQ ID NO: 124016 - DNA, 25 bp, mus musculus
taggctctgacagcagctcactgtc

SEQ ID NO: 124017 - DNA, 25 bp, mus musculus
ctgacagcagctcactgtctagctt

SEQ ID NO: 124018 - DNA, 25 bp, mus musculus
tttgttcttaatattcctcagagat

SEQ ID NO: 124019 - DNA, 25 bp, mus musculus
cttaatattcctcagagatttctca

SEQ ID NO: 124020 - DNA, 25 bp, mus musculus
attcctcagagatttctcagactct

SEQ ID NO: 124021 - DNA, 25 bp, mus musculus
tcccataaccaccactgtaggttgg

SEQ ID NO: 124022 - DNA, 25 bp, mus musculus
cataaccaccactgtaggttggctt

SEQ ID NO: 124023 - DNA, 25 bp, mus musculus
tttaggacaacattgcctcacagcc

SEQ ID NO: 124024 - DNA, 25 bp, mus musculus
gggcatcttgccagtgaccgtttat

SEQ ID NO: 124025 - DNA, 25 bp, mus musculus
catcttgccagtgaccgtttatgac

SEQ ID NO: 124026 - DNA, 25 bp, mus musculus
cttccattttgctcgggacccactg

SEQ ID NO: 124027 - DNA, 25 bp, mus musculus
ccattttgctcgggacccactgcca

SEQ ID NO: 124028 - DNA, 25 bp, mus musculus
gcccatccggaacatcgttttccag

SEQ ID NO: 124029 - DNA, 25 bp, mus musculus
catccggaacatcgttttccagtca

SEQ ID NO: 124030 - DNA, 25 bp, mus musculus
gaacatcgttttccagtcagccgtc

SEQ ID NO: 124031 - DNA, 25 bp, mus musculus
cgtccccaaggtcatgaaggtgagg

SEQ ID NO: 124032 - DNA, 25 bp, mus musculus
accttccggcacagagctgccagcg

SEQ ID NO: 124033 - DNA, 25 bp, mus musculus
ttccggcacagagctgccagcgttc

SEQ ID NO: 124034 - DNA, 25 bp, mus musculus
cggcacagagctgccagcgttcaac

SEQ ID NO: 124035 - DNA, 25 bp, mus musculus
gctccttgctaacccccagaaggag

SEQ ID NO: 124036 - DNA, 25 bp, mus musculus
cttgccagtgaccgtttatgaccag

SEQ ID NO: 124037 - DNA, 25 bp, mus musculus
gaccgtttatgaccagcatggcttc

SEQ ID NO: 124038 - DNA, 25 bp, mus musculus
cgtttatgaccagcatggcttccgt

SEQ ID NO: 124039 - DNA, 25 bp, mus musculus
ttatgaccagcatggcttccgtgtc

SEQ ID NO: 124040 - DNA, 25 bp, mus musculus
gcatggcttccgtgtcctcttccat

SEQ ID NO: 124041 - DNA, 25 bp, mus musculus
tggcttccgtgtcctcttccatttt

SEQ ID NO: 124042 - DNA, 25 bp, mus musculus
cttccgtgtcctcttccattttgct

SEQ ID NO: 124043 - DNA, 25 bp, mus musculus
tgtcctcttccattttgctcgggac

SEQ ID NO: 124044 - DNA, 25 bp, mus musculus
aatgttacactctgagctggttagc

SEQ ID NO: 124045 - DNA, 25 bp, mus musculus
atgttacactctgagctggttagca

SEQ ID NO: 124046 - DNA, 25 bp, mus musculus
gatgcccagttcagaagattggctg

SEQ ID NO: 124047 - DNA, 25 bp, mus musculus
atgcccagttcagaagattggctga

SEQ ID NO: 124048 - DNA, 25 bp, mus musculus
tgcccagttcagaagattggctgat

SEQ ID NO: 124049 - DNA, 25 bp, mus musculus
aagattggctgatcagcttgagagt

SEQ ID NO: 124050 - DNA, 25 bp, mus musculus
agattggctgatcagcttgagagtt

SEQ ID NO: 124051 - DNA, 25 bp, mus musculus
gattggctgatcagcttgagagtta

SEQ ID NO: 124052 - DNA, 25 bp, mus musculus
attggctgatcagcttgagagttat

SEQ ID NO: 124053 - DNA, 25 bp, mus musculus
tggctgatcagcttgagagttatct

SEQ ID NO: 124054 - DNA, 25 bp, mus musculus
tgttacactctgagctggttagcaa

SEQ ID NO: 124055 - DNA, 25 bp, mus musculus
gttacactctgagctggttagcaaa

SEQ ID NO: 124056 - DNA, 25 bp, mus musculus
ttacactctgagctggttagcaaag

SEQ ID NO: 124057 - DNA, 25 bp, mus musculus
tacactctgagctggttagcaaagc

SEQ ID NO: 124058 - DNA, 25 bp, mus musculus
ttatgggatgcccagttcagaagat

SEQ ID NO: 124059 - DNA, 25 bp, mus musculus
tgggatgcccagttcagaagattgg

SEQ ID NO: 124060 - DNA, 25 bp, mus musculus
gggatgcccagttcagaagattggc

SEQ ID NO: 124061 - DNA, 25 bp, mus musculus
ggatgcccagttcagaagattggct

SEQ ID NO: 124062 - DNA, 25 bp, mus musculus
aagctaatctcggtgattgcagtag

SEQ ID NO: 124063 - DNA, 25 bp, mus musculus
ctaatctcggtgattgcagtagagg

SEQ ID NO: 124064 - DNA, 25 bp, mus musculus
gaatactctttcatgcagtttctaa

SEQ ID NO: 124065 - DNA, 25 bp, mus musculus
aatactctttcatgcagtttctaaa

SEQ ID NO: 124066 - DNA, 25 bp, mus musculus
tggttcagcacgcgcttgatgcaca

SEQ ID NO: 124067 - DNA, 25 bp, mus musculus
gttcagcacgcgcttgatgcacacc

SEQ ID NO: 124068 - DNA, 25 bp, mus musculus
ttcagcacgcgcttgatgcacacca

SEQ ID NO: 124069 - DNA, 25 bp, mus musculus
cagcacgcgcttgatgcacaccaga

SEQ ID NO: 124070 - DNA, 25 bp, mus musculus
agcacgcgcttgatgcacaccagag

SEQ ID NO: 124071 - DNA, 25 bp, mus musculus
acgcgcttgatgcacaccagaggtg

SEQ ID NO: 124072 - DNA, 25 bp, mus musculus
gcgcttgatgcacaccagaggtgca

SEQ ID NO: 124073 - DNA, 25 bp, mus musculus
cgcttgatgcacaccagaggtgcat

SEQ ID NO: 124074 - DNA, 25 bp, mus musculus
taatctcggtgattgcagtagagga

SEQ ID NO: 124075 - DNA, 25 bp, mus musculus
ctggcttcctgttggcgcggatagg

SEQ ID NO: 124076 - DNA, 25 bp, mus musculus
gcttcctgttggcgcggataggaga

SEQ ID NO: 124077 - DNA, 25 bp, mus musculus
tcctgttggcgcggataggagagct

SEQ ID NO: 124078 - DNA, 25 bp, mus musculus
ctgttggcgcggataggagagctat

SEQ ID NO: 124079 - DNA, 25 bp, mus musculus
ccactatcaatgtgatcgaatactc

SEQ ID NO: 124080 - DNA, 25 bp, mus musculus
tgatcgaatactctttcatgcagtt

SEQ ID NO: 124081 - DNA, 25 bp, mus musculus
tcgaatactctttcatgcagtttct

SEQ ID NO: 124082 - DNA, 25 bp, mus musculus
cacatgcaaaaccccacaagtgtag

SEQ ID NO: 124083 - DNA, 25 bp, mus musculus
gtagttccagatatgctggaatgtt

SEQ ID NO: 124084 - DNA, 25 bp, mus musculus
ctaactttgtgtccgtctccatcca

SEQ ID NO: 124085 - DNA, 25 bp, mus musculus
actttgtgtccgtctccatccatga

SEQ ID NO: 124086 - DNA, 25 bp, mus musculus
attgtctgtctcactgagccaactt

SEQ ID NO: 124087 - DNA, 25 bp, mus musculus
gtctgtctcactgagccaacttaac

SEQ ID NO: 124088 - DNA, 25 bp, mus musculus
ctcactgagccaacttaactctgat

SEQ ID NO: 124089 - DNA, 25 bp, mus musculus
actgagccaacttaactctgatgaa

SEQ ID NO: 124090 - DNA, 25 bp, mus musculus
gagccaacttaactctgatgaaaca

SEQ ID NO: 124091 - DNA, 25 bp, mus musculus
acttaactctgatgaaacagtacaa

SEQ ID NO: 124092 - DNA, 25 bp, mus musculus
agaagaaaactcacctgtgtgaaga

SEQ ID NO: 124093 - DNA, 25 bp, mus musculus
aaactcacctgtgtgaagaaatggt

SEQ ID NO: 124094 - DNA, 25 bp, mus musculus
gttccagatatgctggaatgttagc

SEQ ID NO: 124095 - DNA, 25 bp, mus musculus
tagcccttgctaggagaaagctggt

SEQ ID NO: 124096 - DNA, 25 bp, mus musculus
aggtgaccgatttcatcaagtttgg

SEQ ID NO: 124097 - DNA, 25 bp, mus musculus
tgaccgatttcatcaagtttggagt

SEQ ID NO: 124098 - DNA, 25 bp, mus musculus
tgttaccggcatccccattattgct

SEQ ID NO: 124099 - DNA, 25 bp, mus musculus
taccggcatccccattattgctaat

SEQ ID NO: 124100 - DNA, 25 bp, mus musculus
cggcatccccattattgctaattca

SEQ ID NO: 124101 - DNA, 25 bp, mus musculus
tttgtggtgctaactttgtgtccgt

SEQ ID NO: 124102 - DNA, 25 bp, mus musculus
cagtcctgcaggctcaccatgccaa

SEQ ID NO: 124103 - DNA, 25 bp, mus musculus
gcactgttgctgctgctacctctta

SEQ ID NO: 124104 - DNA, 25 bp, mus musculus
atggcatccagctaaggtctgaaga

SEQ ID NO: 124105 - DNA, 25 bp, mus musculus
ggcatccagctaaggtctgaagaca

SEQ ID NO: 124106 - DNA, 25 bp, mus musculus
gaagacatcctagtttgtctgtgga

SEQ ID NO: 124107 - DNA, 25 bp, mus musculus
agacatcctagtttgtctgtggacc

SEQ ID NO: 124108 - DNA, 25 bp, mus musculus
gtttgtctgtggacctccacaccaa

SEQ ID NO: 124109 - DNA, 25 bp, mus musculus
ttgtctgtggacctccacaccaaga

SEQ ID NO: 124110 - DNA, 25 bp, mus musculus
ctgtggacctccacaccaagaacca

SEQ ID NO: 124111 - DNA, 25 bp, mus musculus
gtggacctccacaccaagaaccaag

SEQ ID NO: 124112 - DNA, 25 bp, mus musculus
ctccacaccaagaaccaagttgcaa

SEQ ID NO: 124113 - DNA, 25 bp, mus musculus
ccacaccaagaaccaagttgcaaat

SEQ ID NO: 124114 - DNA, 25 bp, mus musculus
actgttgctgctgctacctcttaga

SEQ ID NO: 124115 - DNA, 25 bp, mus musculus
tgttgctgctgctacctcttagaca

SEQ ID NO: 124116 - DNA, 25 bp, mus musculus
gctgctgctacctcttagacaagaa

SEQ ID NO: 124117 - DNA, 25 bp, mus musculus
tgctgctacctcttagacaagaaaa

SEQ ID NO: 124118 - DNA, 25 bp, mus musculus
ataacccctcatggcatccagctaa

SEQ ID NO: 124119 - DNA, 25 bp, mus musculus
aacccctcatggcatccagctaagg

SEQ ID NO: 124120 - DNA, 25 bp, mus musculus
cctcatggcatccagctaaggtctg

SEQ ID NO: 124121 - DNA, 25 bp, mus musculus
tcatggcatccagctaaggtctgaa

SEQ ID NO: 124122 - DNA, 25 bp, mus musculus
gtggacctaacattgtctcgaaatg

SEQ ID NO: 124123 - DNA, 25 bp, mus musculus
gacctaacattgtctcgaaatgcca

SEQ ID NO: 124124 - DNA, 25 bp, mus musculus
gtcaacctccagcatctcattctca

SEQ ID NO: 124125 - DNA, 25 bp, mus musculus
cagcatctcattctcagtggcaatc

SEQ ID NO: 124126 - DNA, 25 bp, mus musculus
ctcattctcagtggcaatcaactgg

SEQ ID NO: 124127 - DNA, 25 bp, mus musculus
attctcagtggcaatcaactgggcc

SEQ ID NO: 124128 - DNA, 25 bp, mus musculus
ctcagtggcaatcaactgggccgca

SEQ ID NO: 124129 - DNA, 25 bp, mus musculus
agtggcaatcaactgggccgcatcg

SEQ ID NO: 124130 - DNA, 25 bp, mus musculus
gacgacttccttgacagtctcgagg

SEQ ID NO: 124131 - DNA, 25 bp, mus musculus
ctcgaggacctggatgtgtcctata

SEQ ID NO: 124132 - DNA, 25 bp, mus musculus
cggcaagttccctgggctggcatag

SEQ ID NO: 124133 - DNA, 25 bp, mus musculus
caagttccctgggctggcataggct

SEQ ID NO: 124134 - DNA, 25 bp, mus musculus
ctaacattgtctcgaaatgccatca

SEQ ID NO: 124135 - DNA, 25 bp, mus musculus
ggcataggctccatgcctgccctgc

SEQ ID NO: 124136 - DNA, 25 bp, mus musculus
acattgtctcgaaatgccatcaccc

SEQ ID NO: 124137 - DNA, 25 bp, mus musculus
tctcgaaatgccatcacccgcattg

SEQ ID NO: 124138 - DNA, 25 bp, mus musculus
cgaaatgccatcacccgcattgggg

SEQ ID NO: 124139 - DNA, 25 bp, mus musculus
gccatcacccgcattggggctcgct

SEQ ID NO: 124140 - DNA, 25 bp, mus musculus
agcctgcgctccttgcacctggatg

SEQ ID NO: 124141 - DNA, 25 bp, mus musculus
tccttgcacctggatggcaacaggc

SEQ ID NO: 124142 - DNA, 25 bp, mus musculus
gggcctgtcaacctccagcatctca

SEQ ID NO: 124143 - DNA, 25 bp, mus musculus
caaagactgactccttaggcttctt

SEQ ID NO: 124144 - DNA, 25 bp, mus musculus
ctgactccttaggcttctttcctgt

SEQ ID NO: 124145 - DNA, 25 bp, mus musculus
ctgatttctttggtgtttagaggag

SEQ ID NO: 124146 - DNA, 25 bp, mus musculus
tcacttctcaaggatggtaaactaa

SEQ ID NO: 124147 - DNA, 25 bp, mus musculus
acacattcttttctctgtaagacag

SEQ ID NO: 124148 - DNA, 25 bp, mus musculus
gttatatgcctgaactgtcacatca

SEQ ID NO: 124149 - DNA, 25 bp, mus musculus
tgcctgaactgtcacatcattttaa

SEQ ID NO: 124150 - DNA, 25 bp, mus musculus
ggagtcttacatgcagcatgctaga

SEQ ID NO: 124151 - DNA, 25 bp, mus musculus
gcagcatgctagactacgatccctg

SEQ ID NO: 124152 - DNA, 25 bp, mus musculus
tgctagactacgatccctgcatgct

SEQ ID NO: 124153 - DNA, 25 bp, mus musculus
atccctgcatgcttgttctctaaat

SEQ ID NO: 124154 - DNA, 25 bp, mus musculus
tttgttctgctgctaataaagtagt

SEQ ID NO: 124155 - DNA, 25 bp, mus musculus
tgatgctatacggcttttctaaatg

SEQ ID NO: 124156 - DNA, 25 bp, mus musculus
gcttttctaaatgctctacagctaa

SEQ ID NO: 124157 - DNA, 25 bp, mus musculus
ctaaatgctctacagctaatggaga

SEQ ID NO: 124158 - DNA, 25 bp, mus musculus
tcttcacaggctcatgttgtgactg

SEQ ID NO: 124159 - DNA, 25 bp, mus musculus
aactattgtatcagctctctggtag

SEQ ID NO: 124160 - DNA, 25 bp, mus musculus
agctctctggtagcagaaacacatc

SEQ ID NO: 124161 - DNA, 25 bp, mus musculus
acacatctgatctgaaaggtttcct

SEQ ID NO: 124162 - DNA, 25 bp, mus musculus
tgaaaggtttcctgtggagtctatt

SEQ ID NO: 124163 - DNA, 25 bp, mus musculus
agtctgccaccagacccagcagaag

SEQ ID NO: 124164 - DNA, 25 bp, mus musculus
ctgccaccagacccagcagaagcag

SEQ ID NO: 124165 - DNA, 25 bp, mus musculus
agccattgagtcgctcaaggtgtat

SEQ ID NO: 124166 - DNA, 25 bp, mus musculus
tgagtcgctcaaggtgtatcctgtt

SEQ ID NO: 124167 - DNA, 25 bp, mus musculus
gtcgctcaaggtgtatcctgttctg

SEQ ID NO: 124168 - DNA, 25 bp, mus musculus
gtatcctgttctgcagatttttcat

SEQ ID NO: 124169 - DNA, 25 bp, mus musculus
tcatcttggtttctgaatgactacc

SEQ ID NO: 124170 - DNA, 25 bp, mus musculus
tttctgaatgactacctcccaattc

SEQ ID NO: 124171 - DNA, 25 bp, mus musculus
gactacctcccaattctagtgtctc

SEQ ID NO: 124172 - DNA, 25 bp, mus musculus
ctcccaattctagtgtctcctcagt

SEQ ID NO: 124173 - DNA, 25 bp, mus musculus
attctagtgtctcctcagtcaataa

SEQ ID NO: 124174 - DNA, 25 bp, mus musculus
ctagtgtctcctcagtcaataaatt

SEQ ID NO: 124175 - DNA, 25 bp, mus musculus
tacctggccgtgcaagtaaggtcac

SEQ ID NO: 124176 - DNA, 25 bp, mus musculus
tcaccgggttgcaacggagacaaca

SEQ ID NO: 124177 - DNA, 25 bp, mus musculus
tgggcttaactttctcatgaatttg

SEQ ID NO: 124178 - DNA, 25 bp, mus musculus
taactttctcatgaatttgcctgag

SEQ ID NO: 124179 - DNA, 25 bp, mus musculus
ctttctcatgaatttgcctgaggtt

SEQ ID NO: 124180 - DNA, 25 bp, mus musculus
tctcatgaatttgcctgaggtttcc

SEQ ID NO: 124181 - DNA, 25 bp, mus musculus
catgaatttgcctgaggtttccaaa

SEQ ID NO: 124182 - DNA, 25 bp, mus musculus
agaagccattgagtcgctcaaggtg

SEQ ID NO: 124183 - DNA, 25 bp, mus musculus
cagtaaccctcttctatataagcat

SEQ ID NO: 124184 - DNA, 25 bp, mus musculus
ccctcttctatataagcattagtta

SEQ ID NO: 124185 - DNA, 25 bp, mus musculus
ggctttggcatggttgggtttcata

SEQ ID NO: 124186 - DNA, 25 bp, mus musculus
ttttggccaagaggcttgttagtat

SEQ ID NO: 124187 - DNA, 25 bp, mus musculus
catctgtttagtcatcaaggtttgt

SEQ ID NO: 124188 - DNA, 25 bp, mus musculus
acatcttttgctgaatgtcaaatag

SEQ ID NO: 124189 - DNA, 25 bp, mus musculus
caaatagtcacagtctaagtagcca

SEQ ID NO: 124190 - DNA, 25 bp, mus musculus
ccaaaacctgggatgcaaagacagt

SEQ ID NO: 124191 - DNA, 25 bp, mus musculus
tgattctgcatatggcctggaaaga

SEQ ID NO: 124192 - DNA, 25 bp, mus musculus
acaggaaagccagtctcctacaaag

SEQ ID NO: 124193 - DNA, 25 bp, mus musculus
tggaagatcctggcctctaagtcat

SEQ ID NO: 124194 - DNA, 25 bp, mus musculus
gcctctaagtcatagaccaaagtct

SEQ ID NO: 124195 - DNA, 25 bp, mus musculus
ctaagccaatactcccaacaagcaa

SEQ ID NO: 124196 - DNA, 25 bp, mus musculus
caatactcccaacaagcaagttaga

SEQ ID NO: 124197 - DNA, 25 bp, mus musculus
tcccaacaagcaagttagatcttac

SEQ ID NO: 124198 - DNA, 25 bp, mus musculus
agttagatcttacttctgctgctgt

SEQ ID NO: 124199 - DNA, 25 bp, mus musculus
atcttacttctgctgctgttgctga

SEQ ID NO: 124200 - DNA, 25 bp, mus musculus
cttctgctgctgttgctgaaatgtg

SEQ ID NO: 124201 - DNA, 25 bp, mus musculus
ctgctgttgctgaaatgtggctttg

SEQ ID NO: 124202 - DNA, 25 bp, mus musculus
aaatgtggctttggcatggttgggt

SEQ ID NO: 124203 - DNA, 25 bp, mus musculus
ttgacgccttttcagattatgccaa

SEQ ID NO: 124204 - DNA, 25 bp, mus musculus
ccttttcagattatgccaacttcaa

SEQ ID NO: 124205 - DNA, 25 bp, mus musculus
agattgttccttgcttcaaatatct

SEQ ID NO: 124206 - DNA, 25 bp, mus musculus
ttccaggtagctcagtgccaactaa

SEQ ID NO: 124207 - DNA, 25 bp, mus musculus
agcacaaagttctcagagctcttga

SEQ ID NO: 124208 - DNA, 25 bp, mus musculus
caccaagatcagccacctcaggcat

SEQ ID NO: 124209 - DNA, 25 bp, mus musculus
gatcagccacctcaggcatggggag

SEQ ID NO: 124210 - DNA, 25 bp, mus musculus
ccacctcaggcatggggagtaatga

SEQ ID NO: 124211 - DNA, 25 bp, mus musculus
agaccagagcgcctctctggcacca

SEQ ID NO: 124212 - DNA, 25 bp, mus musculus
ctctctggcaccacagcagggatcg

SEQ ID NO: 124213 - DNA, 25 bp, mus musculus
ggcaccacagcagggatcgtcaggt

SEQ ID NO: 124214 - DNA, 25 bp, mus musculus
taataaacactcttgattccctgag

SEQ ID NO: 124215 - DNA, 25 bp, mus musculus
cagattatgccaacttcaagtgaca

SEQ ID NO: 124216 - DNA, 25 bp, mus musculus
atgccaacttcaagtgacaggtgac

SEQ ID NO: 124217 - DNA, 25 bp, mus musculus
caaggcccacagacaggagaattgc

SEQ ID NO: 124218 - DNA, 25 bp, mus musculus
aatggcacataggcttctattacct

SEQ ID NO: 124219 - DNA, 25 bp, mus musculus
gcttctattacctgttaggtggaga

SEQ ID NO: 124220 - DNA, 25 bp, mus musculus
ttagcactgatagtccttttccagt

SEQ ID NO: 124221 - DNA, 25 bp, mus musculus
taatgaaatcctcagcctggaaact

SEQ ID NO: 124222 - DNA, 25 bp, mus musculus
cagcctggaaactgggccagattgt

SEQ ID NO: 124223 - DNA, 25 bp, mus musculus
tcaagcccaattacgacgtgactct

SEQ ID NO: 124224 - DNA, 25 bp, mus musculus
ccaattacgacgtgactctgacaaa

SEQ ID NO: 124225 - DNA, 25 bp, mus musculus
ttcccttggggcacataaagcgaat

SEQ ID NO: 124226 - DNA, 25 bp, mus musculus
tcaatgccattaacaattctgaaat

SEQ ID NO: 124227 - DNA, 25 bp, mus musculus
ggttacggctctgcattcaatcgaa

SEQ ID NO: 124228 - DNA, 25 bp, mus musculus
ggctctgcattcaatcgaaatggga

SEQ ID NO: 124229 - DNA, 25 bp, mus musculus
ctttggccctaaagatggcaactga

SEQ ID NO: 124230 - DNA, 25 bp, mus musculus
tgaaattcacacgtcctctattcaa

SEQ ID NO: 124231 - DNA, 25 bp, mus musculus
tcacacgtcctctattcaaggatct

SEQ ID NO: 124232 - DNA, 25 bp, mus musculus
gtcctctattcaaggatctcgctgc

SEQ ID NO: 124233 - DNA, 25 bp, mus musculus
cccatgatcaagctgtccacaccta

SEQ ID NO: 124234 - DNA, 25 bp, mus musculus
atcaagctgtccacacctaccaaga

SEQ ID NO: 124235 - DNA, 25 bp, mus musculus
acgacgtgactctgacaaatgcttg

SEQ ID NO: 124236 - DNA, 25 bp, mus musculus
tgactctgacaaatgcttgcattgc

SEQ ID NO: 124237 - DNA, 25 bp, mus musculus
atgcttgcattgccttaagtcaaag

SEQ ID NO: 124238 - DNA, 25 bp, mus musculus
tcagcatcgcagacctgaaggatct

SEQ ID NO: 124239 - DNA, 25 bp, mus musculus
acctgaaggatctctcgtcccatca

SEQ ID NO: 124240 - DNA, 25 bp, mus musculus
aggatctctcgtcccatcagctgaa

SEQ ID NO: 124241 - DNA, 25 bp, mus musculus
atgagttcctggcacaggtgcttca

SEQ ID NO: 124242 - DNA, 25 bp, mus musculus
tgcttcagaaggcacctcttccctt

SEQ ID NO: 124243 - DNA, 25 bp, mus musculus
ccctcagagaaccatggcgtctggc

SEQ ID NO: 124244 - DNA, 25 bp, mus musculus
cctcagagaaccatggcgtctggca

SEQ ID NO: 124245 - DNA, 25 bp, mus musculus
gtgcactacgcggcccgagaggcca

SEQ ID NO: 124246 - DNA, 25 bp, mus musculus
cggcccgagaggccatggcattcct

SEQ ID NO: 124247 - DNA, 25 bp, mus musculus
ggcccgagaggccatggcattcctt

SEQ ID NO: 124248 - DNA, 25 bp, mus musculus
gcccgagaggccatggcattccttc

SEQ ID NO: 124249 - DNA, 25 bp, mus musculus
gaggccatggcattccttcgggaat

SEQ ID NO: 124250 - DNA, 25 bp, mus musculus
aggccatggcattccttcgggaata

SEQ ID NO: 124251 - DNA, 25 bp, mus musculus
ggccatggcattccttcgggaatac

SEQ ID NO: 124252 - DNA, 25 bp, mus musculus
ccatggcattccttcgggaatactt

SEQ ID NO: 124253 - DNA, 25 bp, mus musculus
catggcattccttcgggaatacttt

SEQ ID NO: 124254 - DNA, 25 bp, mus musculus
atggcattccttcgggaatactttg

SEQ ID NO: 124255 - DNA, 25 bp, mus musculus
agagaaccatggcgtctggcagtat

SEQ ID NO: 124256 - DNA, 25 bp, mus musculus
gagaaccatggcgtctggcagtatg

SEQ ID NO: 124257 - DNA, 25 bp, mus musculus
gaaccatggcgtctggcagtatggc

SEQ ID NO: 124258 - DNA, 25 bp, mus musculus
aaccatggcgtctggcagtatggca

SEQ ID NO: 124259 - DNA, 25 bp, mus musculus
accatggcgtctggcagtatggcaa

SEQ ID NO: 124260 - DNA, 25 bp, mus musculus
catggcgtctggcagtatggcaacc

SEQ ID NO: 124261 - DNA, 25 bp, mus musculus
gtgcagctgtgcactacgcggcccg

SEQ ID NO: 124262 - DNA, 25 bp, mus musculus
cagctgtgcactacgcggcccgaga

SEQ ID NO: 124263 - DNA, 25 bp, mus musculus
caaagcccctagagctgagttctca

SEQ ID NO: 124264 - DNA, 25 bp, mus musculus
agctgagttctcagaacttgaagag

SEQ ID NO: 124265 - DNA, 25 bp, mus musculus
ctgcatgttcaggcatgtttcaggg

SEQ ID NO: 124266 - DNA, 25 bp, mus musculus
gttcaggcatgtttcagggatgtgc

SEQ ID NO: 124267 - DNA, 25 bp, mus musculus
gcatgtttcagggatgtgcgggcaa

SEQ ID NO: 124268 - DNA, 25 bp, mus musculus
tcagtctttggtctttgaaaccaga

SEQ ID NO: 124269 - DNA, 25 bp, mus musculus
cactgcaggagtcagttgggaaccc

SEQ ID NO: 124270 - DNA, 25 bp, mus musculus
ggaaccctggattgtccactcctca

SEQ ID NO: 124271 - DNA, 25 bp, mus musculus
ctggattgtccactcctcataagta

SEQ ID NO: 124272 - DNA, 25 bp, mus musculus
tgtccactcctcataagtatctttt

SEQ ID NO: 124273 - DNA, 25 bp, mus musculus
ataagtatcttttctctgctcattc

SEQ ID NO: 124274 - DNA, 25 bp, mus musculus
tctctgctcattccagggctacaaa

SEQ ID NO: 124275 - DNA, 25 bp, mus musculus
gccttcttggctcttggctgccctc

SEQ ID NO: 124276 - DNA, 25 bp, mus musculus
tcaagaccctcaaacccaggtgcct

SEQ ID NO: 124277 - DNA, 25 bp, mus musculus
aacagtgcaatggctcctcctcaag

SEQ ID NO: 124278 - DNA, 25 bp, mus musculus
gcaatggctcctcctcaagttccat

SEQ ID NO: 124279 - DNA, 25 bp, mus musculus
gctcctcctcaagttccattccagg

SEQ ID NO: 124280 - DNA, 25 bp, mus musculus
cctcaagttccattccaggcatcca

SEQ ID NO: 124281 - DNA, 25 bp, mus musculus
ttccaggcatccagtaggctctgcc

SEQ ID NO: 124282 - DNA, 25 bp, mus musculus
cctgtgctgcatgttcaggcatgtt

SEQ ID NO: 124283 - DNA, 25 bp, mus musculus
aaactgccttcgacatccttcagta

SEQ ID NO: 124284 - DNA, 25 bp, mus musculus
ccttcgacatccttcagtactcaga

SEQ ID NO: 124285 - DNA, 25 bp, mus musculus
tcagcctggcaggctttggctacga

SEQ ID NO: 124286 - DNA, 25 bp, mus musculus
gctacgacctcagtcaacccaggac

SEQ ID NO: 124287 - DNA, 25 bp, mus musculus
cccctctgcactactttgacagtca

SEQ ID NO: 124288 - DNA, 25 bp, mus musculus
actttgacagtcagtgcatgggcgc

SEQ ID NO: 124289 - DNA, 25 bp, mus musculus
acagtcagtgcatgggcgccatgca

SEQ ID NO: 124290 - DNA, 25 bp, mus musculus
ccatgcactggcaggtcatgcacaa

SEQ ID NO: 124291 - DNA, 25 bp, mus musculus
tgcacaatgtgaccacagagaccaa

SEQ ID NO: 124292 - DNA, 25 bp, mus musculus
atgtgaccacagagaccaagttcct

SEQ ID NO: 124293 - DNA, 25 bp, mus musculus
agaccaagttcctcctgaagctcct

SEQ ID NO: 124294 - DNA, 25 bp, mus musculus
agttcctcctgaagctcctcaagga

SEQ ID NO: 124295 - DNA, 25 bp, mus musculus
acatccttcagtactcagagcctca

SEQ ID NO: 124296 - DNA, 25 bp, mus musculus
ttcagtactcagagcctcagtcaag

SEQ ID NO: 124297 - DNA, 25 bp, mus musculus
agcctcagtcaagattctggggcca

SEQ ID NO: 124298 - DNA, 25 bp, mus musculus
agtcaagattctggggccatgataa

SEQ ID NO: 124299 - DNA, 25 bp, mus musculus
gattctggggccatgataagaacat

SEQ ID NO: 124300 - DNA, 25 bp, mus musculus
gcgtcattgccgttgtcttggctac

SEQ ID NO: 124301 - DNA, 25 bp, mus musculus
ttgtcttggctacacatctgtgtga

SEQ ID NO: 124302 - DNA, 25 bp, mus musculus
tggctacacatctgtgtgatgaagt

SEQ ID NO: 124303 - DNA, 25 bp, mus musculus
ctctcacctgtctgcttatccagct

SEQ ID NO: 124304 - DNA, 25 bp, mus musculus
cctgtctgcttatccagctctggaa

SEQ ID NO: 124305 - DNA, 25 bp, mus musculus
actgcttcctgcaagagccaacact

SEQ ID NO: 124306 - DNA, 25 bp, mus musculus
tcctgcaagagccaacactcagcag

SEQ ID NO: 124307 - DNA, 25 bp, mus musculus
aagagccaacactcagcagacagag

SEQ ID NO: 124308 - DNA, 25 bp, mus musculus
caacactcagcagacagagcctacg

SEQ ID NO: 124309 - DNA, 25 bp, mus musculus
tcagcagacagagcctacgagcaac

SEQ ID NO: 124310 - DNA, 25 bp, mus musculus
gcctacgagcaaccaatccttgcag

SEQ ID NO: 124311 - DNA, 25 bp, mus musculus
gagcaaccaatccttgcagagactc

SEQ ID NO: 124312 - DNA, 25 bp, mus musculus
ccaatccttgcagagactccagtat

SEQ ID NO: 124313 - DNA, 25 bp, mus musculus
aatcctctaggagccactgtgacca

SEQ ID NO: 124314 - DNA, 25 bp, mus musculus
cttggactctgacgccattgaacaa

SEQ ID NO: 124315 - DNA, 25 bp, mus musculus
tgacaactcctctgacagtgactat

SEQ ID NO: 124316 - DNA, 25 bp, mus musculus
tgactatgacctgcaagtggctcag

SEQ ID NO: 124317 - DNA, 25 bp, mus musculus
tgacctgcaagtggctcagagactg

SEQ ID NO: 124318 - DNA, 25 bp, mus musculus
gcgccagtgtctacgcttggacatt

SEQ ID NO: 124319 - DNA, 25 bp, mus musculus
ccactttgagtgctgcccacttcca

SEQ ID NO: 124320 - DNA, 25 bp, mus musculus
tgagtgctgcccacttccacttcag

SEQ ID NO: 124321 - DNA, 25 bp, mus musculus
gccaaggtcctctggacaagatcgc

SEQ ID NO: 124322 - DNA, 25 bp, mus musculus
cacggcagcctgactgcttcctgca

SEQ ID NO: 124323 - DNA, 25 bp, mus musculus
atttccatggtgctgggcctcatag

SEQ ID NO: 124324 - DNA, 25 bp, mus musculus
ttgatctccatctggggagccaagt

SEQ ID NO: 124325 - DNA, 25 bp, mus musculus
tgccttcagatagtgacagagccca

SEQ ID NO: 124326 - DNA, 25 bp, mus musculus
gtgacagagcccaagtcctcggatc

SEQ ID NO: 124327 - DNA, 25 bp, mus musculus
gagcccaagtcctcggatctctgga

SEQ ID NO: 124328 - DNA, 25 bp, mus musculus
tcggatctctggatcatcacccaga

SEQ ID NO: 124329 - DNA, 25 bp, mus musculus
ctctggatcatcacccagacggtca

SEQ ID NO: 124330 - DNA, 25 bp, mus musculus
atcatcacccagacggtcactcaca

SEQ ID NO: 124331 - DNA, 25 bp, mus musculus
acccagacggtcactcacattgggg

SEQ ID NO: 124332 - DNA, 25 bp, mus musculus
actcacattggggctctcagcttcg

SEQ ID NO: 124333 - DNA, 25 bp, mus musculus
gctctcagcttcgctgtggcgatgg

SEQ ID NO: 124334 - DNA, 25 bp, mus musculus
gtgactggactcctcacaggttgtc

SEQ ID NO: 124335 - DNA, 25 bp, mus musculus
tccatctggggagccaagtgtccac

SEQ ID NO: 124336 - DNA, 25 bp, mus musculus
gccaagtgtccacgggcgtgtttga

SEQ ID NO: 124337 - DNA, 25 bp, mus musculus
tgtttgaaccacatgctgcagaact

SEQ ID NO: 124338 - DNA, 25 bp, mus musculus
aaccacatgctgcagaactccagtg

SEQ ID NO: 124339 - DNA, 25 bp, mus musculus
atgctgcagaactccagtgggatcc

SEQ ID NO: 124340 - DNA, 25 bp, mus musculus
ctgctgggagcacttacctactact

SEQ ID NO: 124341 - DNA, 25 bp, mus musculus
ggagcacttacctactactgccttc

SEQ ID NO: 124342 - DNA, 25 bp, mus musculus
cttacctactactgccttcagatag

SEQ ID NO: 124343 - DNA, 25 bp, mus musculus
acattcttggctcttctctttcctg

SEQ ID NO: 124344 - DNA, 25 bp, mus musculus
cttctctttcctggtgtgccatgat

SEQ ID NO: 124345 - DNA, 25 bp, mus musculus
ttgtgggatccagtcctggaggaca

SEQ ID NO: 124346 - DNA, 25 bp, mus musculus
caagttcttagcctctgtagctctt

SEQ ID NO: 124347 - DNA, 25 bp, mus musculus
tagctttcccatctttccctgcaag

SEQ ID NO: 124348 - DNA, 25 bp, mus musculus
ctgcaaggccacaccgtgcatttac

SEQ ID NO: 124349 - DNA, 25 bp, mus musculus
ggccacaccgtgcatttacagcagt

SEQ ID NO: 124350 - DNA, 25 bp, mus musculus
accgtgcatttacagcagtgtggca

SEQ ID NO: 124351 - DNA, 25 bp, mus musculus
catttacagcagtgtggcaaggtgt

SEQ ID NO: 124352 - DNA, 25 bp, mus musculus
ggaccttgaacctggctggccaggg

SEQ ID NO: 124353 - DNA, 25 bp, mus musculus
agagctgttgttccttctgggctgt

SEQ ID NO: 124354 - DNA, 25 bp, mus musculus
gttgttccttctgggctgtctccat

SEQ ID NO: 124355 - DNA, 25 bp, mus musculus
tttcctggtgtgccatgatccaggg

SEQ ID NO: 124356 - DNA, 25 bp, mus musculus
gatgtttttcactgtccatgaattc

SEQ ID NO: 124357 - DNA, 25 bp, mus musculus
atggctgtccagtctaagctcaggg

SEQ ID NO: 124358 - DNA, 25 bp, mus musculus
gtccagtctaagctcagggcagcct

SEQ ID NO: 124359 - DNA, 25 bp, mus musculus
gcagcctcttcaaccactgttggcc

SEQ ID NO: 124360 - DNA, 25 bp, mus musculus
tcttcaaccactgttggcccagcct

SEQ ID NO: 124361 - DNA, 25 bp, mus musculus
gccctgtccctcagtattgaacttg

SEQ ID NO: 124362 - DNA, 25 bp, mus musculus
gaacttggctgcttgtgggatccag

SEQ ID NO: 124363 - DNA, 25 bp, mus musculus
ggctgcttgtgggatccagtcctgg

SEQ ID NO: 124364 - DNA, 25 bp, mus musculus
catctgccctcctaatattgaaagt

SEQ ID NO: 124365 - DNA, 25 bp, mus musculus
atctgccctcctaatattgaaagta

SEQ ID NO: 124366 - DNA, 25 bp, mus musculus
catgaccctggaggcacacagccag

SEQ ID NO: 124367 - DNA, 25 bp, mus musculus
tgaccctggaggcacacagccagca

SEQ ID NO: 124368 - DNA, 25 bp, mus musculus
ccctggaggcacacagccagcacag

SEQ ID NO: 124369 - DNA, 25 bp, mus musculus
tctggggtcctgcaatgttcccaca

SEQ ID NO: 124370 - DNA, 25 bp, mus musculus
gcaatgttcccacatgtatcctgaa

SEQ ID NO: 124371 - DNA, 25 bp, mus musculus
caatgttcccacatgtatcctgaat

SEQ ID NO: 124372 - DNA, 25 bp, mus musculus
ttcccacatgtatcctgaatgtccc

SEQ ID NO: 124373 - DNA, 25 bp, mus musculus
tcccacatgtatcctgaatgtcccc

SEQ ID NO: 124374 - DNA, 25 bp, mus musculus
cacatgtatcctgaatgtccccctg

SEQ ID NO: 124375 - DNA, 25 bp, mus musculus
tgaatgtccccctgttgagtccaat

SEQ ID NO: 124376 - DNA, 25 bp, mus musculus
ccctcctaatattgaaagtatggag

SEQ ID NO: 124377 - DNA, 25 bp, mus musculus
gaaataccatgttttgcctttatag

SEQ ID NO: 124378 - DNA, 25 bp, mus musculus
taccatgttttgcctttatagccct

SEQ ID NO: 124379 - DNA, 25 bp, mus musculus
tttatagccctgctgggtaggtagg

SEQ ID NO: 124380 - DNA, 25 bp, mus musculus
taggtgctctaatcctctctagggc

SEQ ID NO: 124381 - DNA, 25 bp, mus musculus
aggtgctctaatcctctctagggct

SEQ ID NO: 124382 - DNA, 25 bp, mus musculus
cattttgttgtggattgctgctcat

SEQ ID NO: 124383 - DNA, 25 bp, mus musculus
tcatgaccctggaggcacacagcca

SEQ ID NO: 124384 - DNA, 25 bp, mus musculus
gccctgctggtgtgccaatcaagga

SEQ ID NO: 124385 - DNA, 25 bp, mus musculus
tgccaatcaaggatcctaacatcag

SEQ ID NO: 124386 - DNA, 25 bp, mus musculus
ctattcttgggcctggaggcatgtg

SEQ ID NO: 124387 - DNA, 25 bp, mus musculus
ttgggcctggaggcatgtgcccagc

SEQ ID NO: 124388 - DNA, 25 bp, mus musculus
tgtgcccagcacatgtaacaggcag

SEQ ID NO: 124389 - DNA, 25 bp, mus musculus
gcccagcacatgtaacaggcagtat

SEQ ID NO: 124390 - DNA, 25 bp, mus musculus
gttcccatgtgtgtcctgtcaatga

SEQ ID NO: 124391 - DNA, 25 bp, mus musculus
cccatgtgtgtcctgtcaatgaccc

SEQ ID NO: 124392 - DNA, 25 bp, mus musculus
atgtgtgtcctgtcaatgacccctg

SEQ ID NO: 124393 - DNA, 25 bp, mus musculus
ctgtcaatgacccctgctgagtcca

SEQ ID NO: 124394 - DNA, 25 bp, mus musculus
tcaatgacccctgctgagtccaata

SEQ ID NO: 124395 - DNA, 25 bp, mus musculus
acccctgctgagtccaataaaagct

SEQ ID NO: 124396 - DNA, 25 bp, mus musculus
ctcatgtgcaaccactctttcctgg

SEQ ID NO: 124397 - DNA, 25 bp, mus musculus
cactctttcctggagtcctctagtg

SEQ ID NO: 124398 - DNA, 25 bp, mus musculus
tctttcctggagtcctctagtgaca

SEQ ID NO: 124399 - DNA, 25 bp, mus musculus
atagaatgtccaatgtggggatagt

SEQ ID NO: 124400 - DNA, 25 bp, mus musculus
aaatctgtacttcttgcaatgtcat

SEQ ID NO: 124401 - DNA, 25 bp, mus musculus
tctgtacttcttgcaatgtcattta

SEQ ID NO: 124402 - DNA, 25 bp, mus musculus
cttcttgcaatgtcatttagttgat

SEQ ID NO: 124403 - DNA, 25 bp, mus musculus
agttgatctgtgctattcttgggcc

SEQ ID NO: 124404 - DNA, 25 bp, mus musculus
gagagacacccaagctggcgaagtg

SEQ ID NO: 124405 - DNA, 25 bp, mus musculus
agagacacccaagctggcgaagtga

SEQ ID NO: 124406 - DNA, 25 bp, mus musculus
gggcctcagccacatctggcagaaa

SEQ ID NO: 124407 - DNA, 25 bp, mus musculus
ggcctcagccacatctggcagaaat

SEQ ID NO: 124408 - DNA, 25 bp, mus musculus
gcctcagccacatctggcagaaata

SEQ ID NO: 124409 - DNA, 25 bp, mus musculus
cctcagccacatctggcagaaatac

SEQ ID NO: 124410 - DNA, 25 bp, mus musculus
ctcagccacatctggcagaaataca

SEQ ID NO: 124411 - DNA, 25 bp, mus musculus
tcagccacatctggcagaaatacac

SEQ ID NO: 124412 - DNA, 25 bp, mus musculus
cagccacatctggcagaaatacacg

SEQ ID NO: 124413 - DNA, 25 bp, mus musculus
ctccaccaaaggagaatgcgtgggt

SEQ ID NO: 124414 - DNA, 25 bp, mus musculus
gagacacccaagctggcgaagtgaa

SEQ ID NO: 124415 - DNA, 25 bp, mus musculus
agacacccaagctggcgaagtgaag

SEQ ID NO: 124416 - DNA, 25 bp, mus musculus
gacacccaagctggcgaagtgaaga

SEQ ID NO: 124417 - DNA, 25 bp, mus musculus
acacccaagctggcgaagtgaagaa

SEQ ID NO: 124418 - DNA, 25 bp, mus musculus
atcgcagactggggcctcagccaca

SEQ ID NO: 124419 - DNA, 25 bp, mus musculus
ctggggcctcagccacatctggcag

SEQ ID NO: 124420 - DNA, 25 bp, mus musculus
tggggcctcagccacatctggcaga

SEQ ID NO: 124421 - DNA, 25 bp, mus musculus
ggggcctcagccacatctggcagaa

SEQ ID NO: 124422 - DNA, 25 bp, mus musculus
aagtcagaggctcctgactactacg

SEQ ID NO: 124423 - DNA, 25 bp, mus musculus
gaggctcctgactactacgaggtta

SEQ ID NO: 124424 - DNA, 25 bp, mus musculus
tatgtgacccggaagctcttcgtag

SEQ ID NO: 124425 - DNA, 25 bp, mus musculus
gtagctgacctgcagcgggtcatcg

SEQ ID NO: 124426 - DNA, 25 bp, mus musculus
atcgccaactgccgggagtacaatc

SEQ ID NO: 124427 - DNA, 25 bp, mus musculus
gagtacaatcccccagacagcgaat

SEQ ID NO: 124428 - DNA, 25 bp, mus musculus
cccccagacagcgaatactgtcgct

SEQ ID NO: 124429 - DNA, 25 bp, mus musculus
gacagcgaatactgtcgctgcgcca

SEQ ID NO: 124430 - DNA, 25 bp, mus musculus
gaatactgtcgctgcgccagtgccc

SEQ ID NO: 124431 - DNA, 25 bp, mus musculus
gccagtgccctggagaagttcttct

SEQ ID NO: 124432 - DNA, 25 bp, mus musculus
gagaagttcttctacttcaagctca

SEQ ID NO: 124433 - DNA, 25 bp, mus musculus
aagttcttctacttcaagctcaaag

SEQ ID NO: 124434 - DNA, 25 bp, mus musculus
gctcctgactactacgaggttatcc

SEQ ID NO: 124435 - DNA, 25 bp, mus musculus
ttccccattgacctgaagaccatga

SEQ ID NO: 124436 - DNA, 25 bp, mus musculus
attgacctgaagaccatgacagaac

SEQ ID NO: 124437 - DNA, 25 bp, mus musculus
gacctgaagaccatgacagaacggt

SEQ ID NO: 124438 - DNA, 25 bp, mus musculus
atgacagaacggttgcgcagtcgct

SEQ ID NO: 124439 - DNA, 25 bp, mus musculus
cggttgcgcagtcgctactatgtga

SEQ ID NO: 124440 - DNA, 25 bp, mus musculus
ttgcgcagtcgctactatgtgaccc

SEQ ID NO: 124441 - DNA, 25 bp, mus musculus
cgcagtcgctactatgtgacccgga

SEQ ID NO: 124442 - DNA, 25 bp, mus musculus
actcaaatacaatctactgctctgt

SEQ ID NO: 124443 - DNA, 25 bp, mus musculus
atacaatctactgctctgtgcagaa

SEQ ID NO: 124444 - DNA, 25 bp, mus musculus
ttaccccatgagcccattcacaggt

SEQ ID NO: 124445 - DNA, 25 bp, mus musculus
catgagcccattcacaggtcaggca

SEQ ID NO: 124446 - DNA, 25 bp, mus musculus
cccattcacaggtcaggcagagtct

SEQ ID NO: 124447 - DNA, 25 bp, mus musculus
agagtctccttggagcctacaggct

SEQ ID NO: 124448 - DNA, 25 bp, mus musculus
tccttggagcctacaggctttgaac

SEQ ID NO: 124449 - DNA, 25 bp, mus musculus
gagcctacaggctttgaacaccctg

SEQ ID NO: 124450 - DNA, 25 bp, mus musculus
acaggctttgaacaccctgcctttg

SEQ ID NO: 124451 - DNA, 25 bp, mus musculus
tttgaacaccctgcctttggatctc

SEQ ID NO: 124452 - DNA, 25 bp, mus musculus
cttatctggacggccttgtctgcct

SEQ ID NO: 124453 - DNA, 25 bp, mus musculus
gatgcacttagtcctgttgggactg

SEQ ID NO: 124454 - DNA, 25 bp, mus musculus
tctactgctctgtgcagaagcctaa

SEQ ID NO: 124455 - DNA, 25 bp, mus musculus
cggcacaaacaccacagcaagatgc

SEQ ID NO: 124456 - DNA, 25 bp, mus musculus
aagatgctgagtctcctgaaagccc

SEQ ID NO: 124457 - DNA, 25 bp, mus musculus
acatcataaatcctcctgtttctgc

SEQ ID NO: 124458 - DNA, 25 bp, mus musculus
ctcctgtttctgcagaaagaacaca

SEQ ID NO: 124459 - DNA, 25 bp, mus musculus
gaacacatcagaattccctgccatg

SEQ ID NO: 124460 - DNA, 25 bp, mus musculus
atcagaattccctgccatggcttag

SEQ ID NO: 124461 - DNA, 25 bp, mus musculus
attccctgccatggcttagactagc

SEQ ID NO: 124462 - DNA, 25 bp, mus musculus
ggacaatagacaaccagctgttctt

SEQ ID NO: 124463 - DNA, 25 bp, mus musculus
accagctgttcttcttcctggtgga

SEQ ID NO: 124464 - DNA, 25 bp, mus musculus
agcaactcaactggaagcaggacaa

SEQ ID NO: 124465 - DNA, 25 bp, mus musculus
ctctctacaaaagtgcgatcacaac

SEQ ID NO: 124466 - DNA, 25 bp, mus musculus
gtgcgatcacaaccactgtcaaccc

SEQ ID NO: 124467 - DNA, 25 bp, mus musculus
ggattcttgtcttggaggacagtgg

SEQ ID NO: 124468 - DNA, 25 bp, mus musculus
ttgtcttggaggacagtggagatag

SEQ ID NO: 124469 - DNA, 25 bp, mus musculus
atgctgccaccgctgagatttttca

SEQ ID NO: 124470 - DNA, 25 bp, mus musculus
ccaccgctgagatttttcagagtga

SEQ ID NO: 124471 - DNA, 25 bp, mus musculus
agagtgaccttcagagggcagcagc

SEQ ID NO: 124472 - DNA, 25 bp, mus musculus
accttcagagggcagcagccattcc

SEQ ID NO: 124473 - DNA, 25 bp, mus musculus
gggctggtccttccataataaagct

SEQ ID NO: 124474 - DNA, 25 bp, mus musculus
tgttcttcttcctggtggagcatgc

SEQ ID NO: 124475 - DNA, 25 bp, mus musculus
cagccagcgggatcgtactgagagt

SEQ ID NO: 124476 - DNA, 25 bp, mus musculus
gagtggatcacacccgtgccatcat

SEQ ID NO: 124477 - DNA, 25 bp, mus musculus
ccatcatactgggctgcacaggggg

SEQ ID NO: 124478 - DNA, 25 bp, mus musculus
tactgggctgcacagggggcatcgt

SEQ ID NO: 124479 - DNA, 25 bp, mus musculus
tggttctggcttaccggctctctgt

SEQ ID NO: 124480 - DNA, 25 bp, mus musculus
accggctctctgtggaaatctacga

SEQ ID NO: 124481 - DNA, 25 bp, mus musculus
tctacgaccgacgggagtacaggcg

SEQ ID NO: 124482 - DNA, 25 bp, mus musculus
tgctcactctgctggagcgctgtgc

SEQ ID NO: 124483 - DNA, 25 bp, mus musculus
cacacagagggaccactgctgaact

SEQ ID NO: 124484 - DNA, 25 bp, mus musculus
atgagaccttccaagaatacaaagc

SEQ ID NO: 124485 - DNA, 25 bp, mus musculus
ccttccaagaatacaaagcatttct

SEQ ID NO: 124486 - DNA, 25 bp, mus musculus
tctcattgcctcaaatgacttgaac

SEQ ID NO: 124487 - DNA, 25 bp, mus musculus
tgcctcaaatgacttgaacatttta

SEQ ID NO: 124488 - DNA, 25 bp, mus musculus
cttgtgactcggaatgctttctaaa

SEQ ID NO: 124489 - DNA, 25 bp, mus musculus
agcctctggtgaccagagcagtttt

SEQ ID NO: 124490 - DNA, 25 bp, mus musculus
tgttacctgagttgcccactgtcaa

SEQ ID NO: 124491 - DNA, 25 bp, mus musculus
ctgagttgcccactgtcaacgctga

SEQ ID NO: 124492 - DNA, 25 bp, mus musculus
ctgtcaacgctgattggaaactgct

SEQ ID NO: 124493 - DNA, 25 bp, mus musculus
tgcccctttcacttatgctactgtg

SEQ ID NO: 124494 - DNA, 25 bp, mus musculus
ctgaactggagccctttggagctac

SEQ ID NO: 124495 - DNA, 25 bp, mus musculus
tggagccctttggagctacaccact

SEQ ID NO: 124496 - DNA, 25 bp, mus musculus
cctttggagctacaccactgcccag

SEQ ID NO: 124497 - DNA, 25 bp, mus musculus
gctttcctgatggtgtcctttggga

SEQ ID NO: 124498 - DNA, 25 bp, mus musculus
ctgatggtgtcctttgggagaaatg

SEQ ID NO: 124499 - DNA, 25 bp, mus musculus
gtaaacatccatctaatctgtcagg

SEQ ID NO: 124500 - DNA, 25 bp, mus musculus
atccatctaatctgtcaggacttta

SEQ ID NO: 124501 - DNA, 25 bp, mus musculus
ctaatctgtcaggactttatgagac

SEQ ID NO: 124502 - DNA, 25 bp, mus musculus
ttatttacattatgcacaggtttag

SEQ ID NO: 124503 - DNA, 25 bp, mus musculus
atttacattatgcacaggtttaggg

SEQ ID NO: 124504 - DNA, 25 bp, mus musculus
ctgtctttggcaaggactgtagtgt

SEQ ID NO: 124505 - DNA, 25 bp, mus musculus
gtctttggcaaggactgtagtgtct

SEQ ID NO: 124506 - DNA, 25 bp, mus musculus
ctttggcaaggactgtagtgtctcc

SEQ ID NO: 124507 - DNA, 25 bp, mus musculus
gactgtagtgtctcctgcagcttgg

SEQ ID NO: 124508 - DNA, 25 bp, mus musculus
ctgtagtgtctcctgcagcttggtg

SEQ ID NO: 124509 - DNA, 25 bp, mus musculus
actttagggacttgatgctggacac

SEQ ID NO: 124510 - DNA, 25 bp, mus musculus
tgatgctggacacggagcagaaacg

SEQ ID NO: 124511 - DNA, 25 bp, mus musculus
atgctggacacggagcagaaacgct

SEQ ID NO: 124512 - DNA, 25 bp, mus musculus
gagcagaaacgcttcttcaggaacg

SEQ ID NO: 124513 - DNA, 25 bp, mus musculus
gcagaaacgcttcttcaggaacgtt

SEQ ID NO: 124514 - DNA, 25 bp, mus musculus
ttacattatgcacaggtttagggac

SEQ ID NO: 124515 - DNA, 25 bp, mus musculus
attatgcacaggtttagggaccgca

SEQ ID NO: 124516 - DNA, 25 bp, mus musculus
gtggatcttatcacctgtcctagat

SEQ ID NO: 124517 - DNA, 25 bp, mus musculus
ggatcttatcacctgtcctagatcg

SEQ ID NO: 124518 - DNA, 25 bp, mus musculus
tcacctgtcctagatcgaaggtacc

SEQ ID NO: 124519 - DNA, 25 bp, mus musculus
tcgaaggtacctgtctttggcaagg

SEQ ID NO: 124520 - DNA, 25 bp, mus musculus
aggtacctgtctttggcaaggactg

SEQ ID NO: 124521 - DNA, 25 bp, mus musculus
gtacctgtctttggcaaggactgta

SEQ ID NO: 124522 - DNA, 25 bp, mus musculus
gccaacacaatgatcaccacacaga

SEQ ID NO: 124523 - DNA, 25 bp, mus musculus
atcaccacacagacacctctgtagg

SEQ ID NO: 124524 - DNA, 25 bp, mus musculus
ttatcagggaacccgtgacctgtct

SEQ ID NO: 124525 - DNA, 25 bp, mus musculus
tttcttagagctgcccctttcatct

SEQ ID NO: 124526 - DNA, 25 bp, mus musculus
agagctgcccctttcatcttgctta

SEQ ID NO: 124527 - DNA, 25 bp, mus musculus
taaattctcagctcatgtgtcagtc

SEQ ID NO: 124528 - DNA, 25 bp, mus musculus
ctcagctcatgtgtcagtctgttta

SEQ ID NO: 124529 - DNA, 25 bp, mus musculus
tcatgtgtcagtctgtttaaccctt

SEQ ID NO: 124530 - DNA, 25 bp, mus musculus
ctgtcctgatctttcttaagttcct

SEQ ID NO: 124531 - DNA, 25 bp, mus musculus
ttcttaagttccttcattcacacta

SEQ ID NO: 124532 - DNA, 25 bp, mus musculus
ttcattcacactaactctgagacag

SEQ ID NO: 124533 - DNA, 25 bp, mus musculus
cacactaactctgagacagatgagc

SEQ ID NO: 124534 - DNA, 25 bp, mus musculus
acacagacacctctgtaggtcagtt

SEQ ID NO: 124535 - DNA, 25 bp, mus musculus
acacctctgtaggtcagttcttcag

SEQ ID NO: 124536 - DNA, 25 bp, mus musculus
tcttcagccaggaagtgattcacat

SEQ ID NO: 124537 - DNA, 25 bp, mus musculus
ttcacattgagttccattggaattc

SEQ ID NO: 124538 - DNA, 25 bp, mus musculus
catcttaatcagacctgtgtgaata

SEQ ID NO: 124539 - DNA, 25 bp, mus musculus
cacccagttagaacagcctctgtgg

SEQ ID NO: 124540 - DNA, 25 bp, mus musculus
ggtttctgagggcacaggagtctca

SEQ ID NO: 124541 - DNA, 25 bp, mus musculus
ttgtctgaactcagaaacttatcag

SEQ ID NO: 124542 - DNA, 25 bp, mus musculus
tgaattctctttgacacaaagcata

SEQ ID NO: 124543 - DNA, 25 bp, mus musculus
ctctttgacacaaagcatacttgta

SEQ ID NO: 124544 - DNA, 25 bp, mus musculus
atagcatgcttgtgcctcaaactgc

SEQ ID NO: 124545 - DNA, 25 bp, mus musculus
tgcttgtgcctcaaactgcaaggaa

SEQ ID NO: 124546 - DNA, 25 bp, mus musculus
tgcctcaaactgcaaggaagcaagt

SEQ ID NO: 124547 - DNA, 25 bp, mus musculus
gaatctgtgatctgctcagctctgg

SEQ ID NO: 124548 - DNA, 25 bp, mus musculus
gaactgcctttagcggtgcacctgg

SEQ ID NO: 124549 - DNA, 25 bp, mus musculus
cctttagcggtgcacctggacatca

SEQ ID NO: 124550 - DNA, 25 bp, mus musculus
cacctggacatcagagccccttgta

SEQ ID NO: 124551 - DNA, 25 bp, mus musculus
gacatcagagccccttgtaagaact

SEQ ID NO: 124552 - DNA, 25 bp, mus musculus
attgctggcagtctagtggagcgta

SEQ ID NO: 124553 - DNA, 25 bp, mus musculus
ctctgtcactgaaggctgtagtaga

SEQ ID NO: 124554 - DNA, 25 bp, mus musculus
cagcacccacttgatataaatctcc

SEQ ID NO: 124555 - DNA, 25 bp, mus musculus
aatctcctgtctgcccatcatatag

SEQ ID NO: 124556 - DNA, 25 bp, mus musculus
ctgtctgcccatcatatagaagaag

SEQ ID NO: 124557 - DNA, 25 bp, mus musculus
caggatctgtagacccggagagaac

SEQ ID NO: 124558 - DNA, 25 bp, mus musculus
gaaccctcactgactggtgcaggga

SEQ ID NO: 124559 - DNA, 25 bp, mus musculus
tcactgactggtgcagggatctcac

SEQ ID NO: 124560 - DNA, 25 bp, mus musculus
tcccctgagctctctgtttaggtat

SEQ ID NO: 124561 - DNA, 25 bp, mus musculus
gagctctctgtttaggtatgtgtct

SEQ ID NO: 124562 - DNA, 25 bp, mus musculus
gcatggctcagaaccccagcaacat

SEQ ID NO: 124563 - DNA, 25 bp, mus musculus
agaaccccagcaacatggagccctt

SEQ ID NO: 124564 - DNA, 25 bp, mus musculus
atgatgtgctcatcagcacgtaccc

SEQ ID NO: 124565 - DNA, 25 bp, mus musculus
atgtgctcatcagcacgtacccaaa

SEQ ID NO: 124566 - DNA, 25 bp, mus musculus
tgctcatcagcacgtacccaaagtc

SEQ ID NO: 124567 - DNA, 25 bp, mus musculus
tcagcacgtacccaaagtctggtac

SEQ ID NO: 124568 - DNA, 25 bp, mus musculus
agtctggtactacctggatgagtga

SEQ ID NO: 124569 - DNA, 25 bp, mus musculus
ctggtactacctggatgagtgagat

SEQ ID NO: 124570 - DNA, 25 bp, mus musculus
atatgatctatcagggtggcaagct

SEQ ID NO: 124571 - DNA, 25 bp, mus musculus
tgatctatcagggtggcaagctaga

SEQ ID NO: 124572 - DNA, 25 bp, mus musculus
tctatcagggtggcaagctagataa

SEQ ID NO: 124573 - DNA, 25 bp, mus musculus
tctatgcccggatacccttccttga

SEQ ID NO: 124574 - DNA, 25 bp, mus musculus
accccagcaacatggagcccttgcg

SEQ ID NO: 124575 - DNA, 25 bp, mus musculus
tacccttccttgagttcagctgccc

SEQ ID NO: 124576 - DNA, 25 bp, mus musculus
gcaacatggagcccttgcgtaaacc

SEQ ID NO: 124577 - DNA, 25 bp, mus musculus
ccttgcgtaaaccactggtgcctgt

SEQ ID NO: 124578 - DNA, 25 bp, mus musculus
tgcgtaaaccactggtgcctgtgaa

SEQ ID NO: 124579 - DNA, 25 bp, mus musculus
gaatcccactcatcaaatactttgc

SEQ ID NO: 124580 - DNA, 25 bp, mus musculus
tcatcaaatactttgcggagacaat

SEQ ID NO: 124581 - DNA, 25 bp, mus musculus
agcaactgcagaacttcacagcctg

SEQ ID NO: 124582 - DNA, 25 bp, mus musculus
agaacttcacagcctggcctgatga

SEQ ID NO: 124583 - DNA, 25 bp, mus musculus
ctgcttgttcaccatcagcctagac

SEQ ID NO: 124584 - DNA, 25 bp, mus musculus
tgcttgttcaccatcagcctagacg

SEQ ID NO: 124585 - DNA, 25 bp, mus musculus
tcagcctagacgaccacactctagg

SEQ ID NO: 124586 - DNA, 25 bp, mus musculus
cagcctagacgaccacactctaggg

SEQ ID NO: 124587 - DNA, 25 bp, mus musculus
agcctagacgaccacactctaggga

SEQ ID NO: 124588 - DNA, 25 bp, mus musculus
gcctagacgaccacactctagggaa

SEQ ID NO: 124589 - DNA, 25 bp, mus musculus
ctagacgaccacactctagggaaca

SEQ ID NO: 124590 - DNA, 25 bp, mus musculus
ctgttaaaaggcccgcatgtgttgt

SEQ ID NO: 124591 - DNA, 25 bp, mus musculus
tgttaaaaggcccgcatgtgttgtt

SEQ ID NO: 124592 - DNA, 25 bp, mus musculus
gcttgttcaccatcagcctagacga

SEQ ID NO: 124593 - DNA, 25 bp, mus musculus
cttgttcaccatcagcctagacgac

SEQ ID NO: 124594 - DNA, 25 bp, mus musculus
ttgttcaccatcagcctagacgacc

SEQ ID NO: 124595 - DNA, 25 bp, mus musculus
tgttcaccatcagcctagacgacca

SEQ ID NO: 124596 - DNA, 25 bp, mus musculus
gttcaccatcagcctagacgaccac

SEQ ID NO: 124597 - DNA, 25 bp, mus musculus
ttcaccatcagcctagacgaccaca

SEQ ID NO: 124598 - DNA, 25 bp, mus musculus
catcagcctagacgaccacactcta

SEQ ID NO: 124599 - DNA, 25 bp, mus musculus
atcagcctagacgaccacactctag

SEQ ID NO: 124600 - DNA, 25 bp, mus musculus
gtaaacccagcatttgggatgtgaa

SEQ ID NO: 124601 - DNA, 25 bp, mus musculus
gaagctaactctcattgaattcaca

SEQ ID NO: 124602 - DNA, 25 bp, mus musculus
tgcttacccgtacagtagtcttgat

SEQ ID NO: 124603 - DNA, 25 bp, mus musculus
taaccagagtcattttctccatctt

SEQ ID NO: 124604 - DNA, 25 bp, mus musculus
gagtcattttctccatctttagaaa

SEQ ID NO: 124605 - DNA, 25 bp, mus musculus
agagctcacagacccgaagctactg

SEQ ID NO: 124606 - DNA, 25 bp, mus musculus
tgcctcacacctgaatgctgtacat

SEQ ID NO: 124607 - DNA, 25 bp, mus musculus
acacctgaatgctgtacatctattt

SEQ ID NO: 124608 - DNA, 25 bp, mus musculus
gaatgctgtacatctatttgattgt

SEQ ID NO: 124609 - DNA, 25 bp, mus musculus
tcatagtaacttctcatgttatgga

SEQ ID NO: 124610 - DNA, 25 bp, mus musculus
cttctcatgttatggaattgatttg

SEQ ID NO: 124611 - DNA, 25 bp, mus musculus
tttgcattgaacacaaactgtaaat

SEQ ID NO: 124612 - DNA, 25 bp, mus musculus
gaatagccacgtttggaatactttg

SEQ ID NO: 124613 - DNA, 25 bp, mus musculus
agttattggtcctgtgcctgaaagg

SEQ ID NO: 124614 - DNA, 25 bp, mus musculus
ttccaatttccttgatatacacata

SEQ ID NO: 124615 - DNA, 25 bp, mus musculus
tttccttgatatacacataccttct

SEQ ID NO: 124616 - DNA, 25 bp, mus musculus
tgatatacacataccttctaaaacc

SEQ ID NO: 124617 - DNA, 25 bp, mus musculus
tttgttcgcatggtcacacactgat

SEQ ID NO: 124618 - DNA, 25 bp, mus musculus
cgcatggtcacacactgatgcttac

SEQ ID NO: 124619 - DNA, 25 bp, mus musculus
gtcacacactgatgcttacccgtac

SEQ ID NO: 124620 - DNA, 25 bp, mus musculus
taggactctgagctctgagggacct

SEQ ID NO: 124621 - DNA, 25 bp, mus musculus
aatccaccaggacctggaggcaggc

SEQ ID NO: 124622 - DNA, 25 bp, mus musculus
cactagctcatgtacacacctatga

SEQ ID NO: 124623 - DNA, 25 bp, mus musculus
ctcatgtacacacctatgaagctcc

SEQ ID NO: 124624 - DNA, 25 bp, mus musculus
tacacacctatgaagctccattatg

SEQ ID NO: 124625 - DNA, 25 bp, mus musculus
cattatgccagactaaaggaggcag

SEQ ID NO: 124626 - DNA, 25 bp, mus musculus
gaccagctgcaggatttggggcatc

SEQ ID NO: 124627 - DNA, 25 bp, mus musculus
tctttccttggtggtcagcacatct

SEQ ID NO: 124628 - DNA, 25 bp, mus musculus
ggtcagcacatctataagtttctcc

SEQ ID NO: 124629 - DNA, 25 bp, mus musculus
cacatctataagtttctcctgactt

SEQ ID NO: 124630 - DNA, 25 bp, mus musculus
tataagtttctcctgacttctgggc

SEQ ID NO: 124631 - DNA, 25 bp, mus musculus
ctgacttctgggcttttctgcctgc

SEQ ID NO: 124632 - DNA, 25 bp, mus musculus
gctactctgtgaagcatcctgtggg

SEQ ID NO: 124633 - DNA, 25 bp, mus musculus
cgacctggcaacctaccacaagagg

SEQ ID NO: 124634 - DNA, 25 bp, mus musculus
tcccatggtagagggctggttccag

SEQ ID NO: 124635 - DNA, 25 bp, mus musculus
caatctgtatgttcctggccaggtg

SEQ ID NO: 124636 - DNA, 25 bp, mus musculus
gtatgttcctggccaggtgaccccg

SEQ ID NO: 124637 - DNA, 25 bp, mus musculus
cgtcctatggattggcagcttggtg

SEQ ID NO: 124638 - DNA, 25 bp, mus musculus
gctgcttgcactggtcttccttgcc

SEQ ID NO: 124639 - DNA, 25 bp, mus musculus
cccagacactagctcatgtacacac

SEQ ID NO: 124640 - DNA, 25 bp, mus musculus
atctctggggcacctgataagtatg

SEQ ID NO: 124641 - DNA, 25 bp, mus musculus
tctggggcacctgataagtatgagt

SEQ ID NO: 124642 - DNA, 25 bp, mus musculus
gacagctacaccctgacagaggagc

SEQ ID NO: 124643 - DNA, 25 bp, mus musculus
agctacaccctgacagaggagctgg

SEQ ID NO: 124644 - DNA, 25 bp, mus musculus
accctgacagaggagctggctgagt

SEQ ID NO: 124645 - DNA, 25 bp, mus musculus
tgtgggctccctttctcttgagagt

SEQ ID NO: 124646 - DNA, 25 bp, mus musculus
gggctccctttctcttgagagtagt

SEQ ID NO: 124647 - DNA, 25 bp, mus musculus
gctgttcctccttgccaacattcct

SEQ ID NO: 124648 - DNA, 25 bp, mus musculus
ccttgccaacattccttgcctacat

SEQ ID NO: 124649 - DNA, 25 bp, mus musculus
cattccttgcctacattagagctcc

SEQ ID NO: 124650 - DNA, 25 bp, mus musculus
tccttgcctacattagagctcccct

SEQ ID NO: 124651 - DNA, 25 bp, mus musculus
cttttaacctcagctgttgagaggg

SEQ ID NO: 124652 - DNA, 25 bp, mus musculus
tccagagaggtctctacccgggatt

SEQ ID NO: 124653 - DNA, 25 bp, mus musculus
gtctctacccgggattgtcactgag

SEQ ID NO: 124654 - DNA, 25 bp, mus musculus
aagcagcgcctgggatctgagagga

SEQ ID NO: 124655 - DNA, 25 bp, mus musculus
gaatccccagaactggacctcagtt

SEQ ID NO: 124656 - DNA, 25 bp, mus musculus
tccccagaactggacctcagttatt

SEQ ID NO: 124657 - DNA, 25 bp, mus musculus
gaactggacctcagttattcccact

SEQ ID NO: 124658 - DNA, 25 bp, mus musculus
ctggacctcagttattcccactcag

SEQ ID NO: 124659 - DNA, 25 bp, mus musculus
gacctcagttattcccactcagacc

SEQ ID NO: 124660 - DNA, 25 bp, mus musculus
ttgtccctgcaactacctggagcca

SEQ ID NO: 124661 - DNA, 25 bp, mus musculus
tccctgcaactacctggagccagtt

SEQ ID NO: 124662 - DNA, 25 bp, mus musculus
aagactccagttgtcaccaggtcac

SEQ ID NO: 124663 - DNA, 25 bp, mus musculus
actccagttgtcaccaggtcacaag

SEQ ID NO: 124664 - DNA, 25 bp, mus musculus
ccagttgtcaccaggtcacaagcaa

SEQ ID NO: 124665 - DNA, 25 bp, mus musculus
gctcagcgtgcctatgccttacatg

SEQ ID NO: 124666 - DNA, 25 bp, mus musculus
cagcgtgcctatgccttacatgctc

SEQ ID NO: 124667 - DNA, 25 bp, mus musculus
gcctatgccttacatgctcaaggtg

SEQ ID NO: 124668 - DNA, 25 bp, mus musculus
gccttacatgctcaaggtgcattac

SEQ ID NO: 124669 - DNA, 25 bp, mus musculus
gcattacaaatacacagtggtcatg

SEQ ID NO: 124670 - DNA, 25 bp, mus musculus
caaatacacagtggtcatggagacg

SEQ ID NO: 124671 - DNA, 25 bp, mus musculus
cccctacagccagcttcggaacatg

SEQ ID NO: 124672 - DNA, 25 bp, mus musculus
ctacctggagccagttgagcttcgg

SEQ ID NO: 124673 - DNA, 25 bp, mus musculus
cagccagcttcggaacatggtgtct

SEQ ID NO: 124674 - DNA, 25 bp, mus musculus
tgagcttcggattcaccctcagtcg

SEQ ID NO: 124675 - DNA, 25 bp, mus musculus
tcagtcgcagccccaggaagatacc

SEQ ID NO: 124676 - DNA, 25 bp, mus musculus
gtcgcagccccaggaagatacctct

SEQ ID NO: 124677 - DNA, 25 bp, mus musculus
gcagccccaggaagatacctctcca

SEQ ID NO: 124678 - DNA, 25 bp, mus musculus
ggaagatacctctccagaatccgat

SEQ ID NO: 124679 - DNA, 25 bp, mus musculus
agatacctctccagaatccgatatt

SEQ ID NO: 124680 - DNA, 25 bp, mus musculus
cccaggaagactccagttgtcacca

SEQ ID NO: 124681 - DNA, 25 bp, mus musculus
gagaagccgagcaccacggtcgcgc

SEQ ID NO: 124682 - DNA, 25 bp, mus musculus
agaagccgagcaccacggtcgcgct

SEQ ID NO: 124683 - DNA, 25 bp, mus musculus
agagtgttgtggctagcgagatgta

SEQ ID NO: 124684 - DNA, 25 bp, mus musculus
tgttgtggctagcgagatgtacctt

SEQ ID NO: 124685 - DNA, 25 bp, mus musculus
ctttaagcctctcgcgagaaacact

SEQ ID NO: 124686 - DNA, 25 bp, mus musculus
tttaagcctctcgcgagaaacactc

SEQ ID NO: 124687 - DNA, 25 bp, mus musculus
ttaagcctctcgcgagaaacactcc

SEQ ID NO: 124688 - DNA, 25 bp, mus musculus
taagcctctcgcgagaaacactcct

SEQ ID NO: 124689 - DNA, 25 bp, mus musculus
aagcctctcgcgagaaacactcctc

SEQ ID NO: 124690 - DNA, 25 bp, mus musculus
tcgcgagaaacactcctcctcgggt

SEQ ID NO: 124691 - DNA, 25 bp, mus musculus
agccgagcaccacggtcgcgctctt

SEQ ID NO: 124692 - DNA, 25 bp, mus musculus
cgagcaccacggtcgcgctcttcga

SEQ ID NO: 124693 - DNA, 25 bp, mus musculus
gagcaccacggtcgcgctcttcgac

SEQ ID NO: 124694 - DNA, 25 bp, mus musculus
tcgcgctcttcgaccgcggcgactt

SEQ ID NO: 124695 - DNA, 25 bp, mus musculus
gatcaagtacatggggcccggcagg

SEQ ID NO: 124696 - DNA, 25 bp, mus musculus
atcaagtacatggggcccggcagga

SEQ ID NO: 124697 - DNA, 25 bp, mus musculus
tcaagtacatggggcccggcaggag

SEQ ID NO: 124698 - DNA, 25 bp, mus musculus
caagtacatggggcccggcaggagt

SEQ ID NO: 124699 - DNA, 25 bp, mus musculus
gattgtaggcacgcgtgtagacaag

SEQ ID NO: 124700 - DNA, 25 bp, mus musculus
tgtaggcacgcgtgtagacaagaat

SEQ ID NO: 124701 - DNA, 25 bp, mus musculus
gagcgtccacttggttggatcctga

SEQ ID NO: 124702 - DNA, 25 bp, mus musculus
ccacttggttggatcctgatttagg

SEQ ID NO: 124703 - DNA, 25 bp, mus musculus
gtgtggctttccgacttgagttcag

SEQ ID NO: 124704 - DNA, 25 bp, mus musculus
tggctttccgacttgagttcagcac

SEQ ID NO: 124705 - DNA, 25 bp, mus musculus
tccgacttgagttcagcaccaactt

SEQ ID NO: 124706 - DNA, 25 bp, mus musculus
ttgagttcagcaccaacttaacttt

SEQ ID NO: 124707 - DNA, 25 bp, mus musculus
tcctaccggagttcaatctggccac

SEQ ID NO: 124708 - DNA, 25 bp, mus musculus
agttcaatctggccactgttaggga

SEQ ID NO: 124709 - DNA, 25 bp, mus musculus
tcaatctggccactgttagggaggc

SEQ ID NO: 124710 - DNA, 25 bp, mus musculus
tggccactgttagggaggcaagaaa

SEQ ID NO: 124711 - DNA, 25 bp, mus musculus
tgacatttttgccattgctctctga

SEQ ID NO: 124712 - DNA, 25 bp, mus musculus
ttttgccattgctctctgatggacg

SEQ ID NO: 124713 - DNA, 25 bp, mus musculus
tgccattgctctctgatggacgact

SEQ ID NO: 124714 - DNA, 25 bp, mus musculus
cattgctctctgatggacgactact

SEQ ID NO: 124715 - DNA, 25 bp, mus musculus
ctgatggacgactacttggggctcg

SEQ ID NO: 124716 - DNA, 25 bp, mus musculus
atggacgactacttggggctcgtga

SEQ ID NO: 124717 - DNA, 25 bp, mus musculus
gactacttggggctcgtgagctgag

SEQ ID NO: 124718 - DNA, 25 bp, mus musculus
tacttggggctcgtgagctgagtga

SEQ ID NO: 124719 - DNA, 25 bp, mus musculus
gtcagatgccagacagtggttccca

SEQ ID NO: 124720 - DNA, 25 bp, mus musculus
tgccagacagtggttcccagacaag

SEQ ID NO: 124721 - DNA, 25 bp, mus musculus
aatacatctctcaatgcctaccttt

SEQ ID NO: 124722 - DNA, 25 bp, mus musculus
aatgcctacctttctatcagatatt

SEQ ID NO: 124723 - DNA, 25 bp, mus musculus
ttccggcgggcaggctctgtacagt

SEQ ID NO: 124724 - DNA, 25 bp, mus musculus
gtacagtgagctccttgaagctttc

SEQ ID NO: 124725 - DNA, 25 bp, mus musculus
tgagctccttgaagctttcaaggtg

SEQ ID NO: 124726 - DNA, 25 bp, mus musculus
ccttgaagctttcaaggtgtgagct

SEQ ID NO: 124727 - DNA, 25 bp, mus musculus
agctttcaaggtgtgagctaaaacg

SEQ ID NO: 124728 - DNA, 25 bp, mus musculus
agacttcctaatgacaacattgtga

SEQ ID NO: 124729 - DNA, 25 bp, mus musculus
tttccatgttgtcaggtagttgtaa

SEQ ID NO: 124730 - DNA, 25 bp, mus musculus
tgtatttacctatgcaaaagattta

SEQ ID NO: 124731 - DNA, 25 bp, mus musculus
gttcccagacaagctcaggcctcca

SEQ ID NO: 124732 - DNA, 25 bp, mus musculus
agacaagctcaggcctccatgaaga

SEQ ID NO: 124733 - DNA, 25 bp, mus musculus
gcctccatgaagatcacctgctcta

SEQ ID NO: 124734 - DNA, 25 bp, mus musculus
atgaagatcacctgctctaatgtcc

SEQ ID NO: 124735 - DNA, 25 bp, mus musculus
tgctctaatgtccctgtgcttagtt

SEQ ID NO: 124736 - DNA, 25 bp, mus musculus
aatgtccctgtgcttagttcggagg

SEQ ID NO: 124737 - DNA, 25 bp, mus musculus
cctgtgcttagttcggaggactgag

SEQ ID NO: 124738 - DNA, 25 bp, mus musculus
tgagtaaatacatctctcaatgcct

SEQ ID NO: 124739 - DNA, 25 bp, mus musculus
tgttccacagactcttcaggcgtca

SEQ ID NO: 124740 - DNA, 25 bp, mus musculus
acagactcttcaggcgtcacatcaa

SEQ ID NO: 124741 - DNA, 25 bp, mus musculus
ttcacctactcctaagaccagttgt

SEQ ID NO: 124742 - DNA, 25 bp, mus musculus
ccacatcaattcaaactccactgga

SEQ ID NO: 124743 - DNA, 25 bp, mus musculus
catcaattcaaactccactggaagc

SEQ ID NO: 124744 - DNA, 25 bp, mus musculus
caattcaaactccactggaagcagc

SEQ ID NO: 124745 - DNA, 25 bp, mus musculus
aagcagctagtttcggctctggcct

SEQ ID NO: 124746 - DNA, 25 bp, mus musculus
cagctagtttcggctctggccttga

SEQ ID NO: 124747 - DNA, 25 bp, mus musculus
ctagtttcggctctggccttgaagt

SEQ ID NO: 124748 - DNA, 25 bp, mus musculus
gctctggccttgaagtcaaaagtgg

SEQ ID NO: 124749 - DNA, 25 bp, mus musculus
gtggaaccagctcagagccttctac

SEQ ID NO: 124750 - DNA, 25 bp, mus musculus
gaaccagctcagagccttctacttt

SEQ ID NO: 124751 - DNA, 25 bp, mus musculus
gactcttcaggcgtcacatcaaagc

SEQ ID NO: 124752 - DNA, 25 bp, mus musculus
cagctcagagccttctactttgaag

SEQ ID NO: 124753 - DNA, 25 bp, mus musculus
tcttcaggcgtcacatcaaagcaat

SEQ ID NO: 124754 - DNA, 25 bp, mus musculus
ggcgtcacatcaaagcaattccaag

SEQ ID NO: 124755 - DNA, 25 bp, mus musculus
gtcacatcaaagcaattccaagagt

SEQ ID NO: 124756 - DNA, 25 bp, mus musculus
acatcaaagcaattccaagagttca

SEQ ID NO: 124757 - DNA, 25 bp, mus musculus
caattccaagagttcacctactcct

SEQ ID NO: 124758 - DNA, 25 bp, mus musculus
ttccaagagttcacctactcctaag

SEQ ID NO: 124759 - DNA, 25 bp, mus musculus
gagttcacctactcctaagaccagt

SEQ ID NO: 124760 - DNA, 25 bp, mus musculus
cggcccgcaacccagatgaaatcgg

SEQ ID NO: 124761 - DNA, 25 bp, mus musculus
cgggaactttatccatcgagaactg

SEQ ID NO: 124762 - DNA, 25 bp, mus musculus
agcttgcaacacttgacgctaattg

SEQ ID NO: 124763 - DNA, 25 bp, mus musculus
gcttgcaacacttgacgctaattgc

SEQ ID NO: 124764 - DNA, 25 bp, mus musculus
ttgcaacacttgacgctaattgccc

SEQ ID NO: 124765 - DNA, 25 bp, mus musculus
tgcaacacttgacgctaattgcccc

SEQ ID NO: 124766 - DNA, 25 bp, mus musculus
gcaacacttgacgctaattgccccg

SEQ ID NO: 124767 - DNA, 25 bp, mus musculus
acacttgacgctaattgccccggct

SEQ ID NO: 124768 - DNA, 25 bp, mus musculus
cacttgacgctaattgccccggcta

SEQ ID NO: 124769 - DNA, 25 bp, mus musculus
ttgacgctaattgccccggctaacg

SEQ ID NO: 124770 - DNA, 25 bp, mus musculus
tgacgctaattgccccggctaacga

SEQ ID NO: 124771 - DNA, 25 bp, mus musculus
tgccccggctaacgattccttgctt

SEQ ID NO: 124772 - DNA, 25 bp, mus musculus
ggaactttatccatcgagaactgga

SEQ ID NO: 124773 - DNA, 25 bp, mus musculus
gaactttatccatcgagaactggaa

SEQ ID NO: 124774 - DNA, 25 bp, mus musculus
aactttatccatcgagaactggaag

SEQ ID NO: 124775 - DNA, 25 bp, mus musculus
ctttatccatcgagaactggaagct

SEQ ID NO: 124776 - DNA, 25 bp, mus musculus
tttatccatcgagaactggaagctt

SEQ ID NO: 124777 - DNA, 25 bp, mus musculus
ttatccatcgagaactggaagcttg

SEQ ID NO: 124778 - DNA, 25 bp, mus musculus
ctggaagcttgcaacacttgacgct

SEQ ID NO: 124779 - DNA, 25 bp, mus musculus
aagcttgcaacacttgacgctaatt

SEQ ID NO: 124780 - DNA, 25 bp, mus musculus
ccatgtgacatccaaatgtggctct

SEQ ID NO: 124781 - DNA, 25 bp, mus musculus
gacatccaaatgtggctctctaaag

SEQ ID NO: 124782 - DNA, 25 bp, mus musculus
cactttggctgaggatgtcactgca

SEQ ID NO: 124783 - DNA, 25 bp, mus musculus
ggatgtcactgcagcgcttgctaag

SEQ ID NO: 124784 - DNA, 25 bp, mus musculus
cactgcagcgcttgctaagcagggc

SEQ ID NO: 124785 - DNA, 25 bp, mus musculus
cttgtgaatacttctcctttagcac

SEQ ID NO: 124786 - DNA, 25 bp, mus musculus
aatacttctcctttagcactggagt

SEQ ID NO: 124787 - DNA, 25 bp, mus musculus
tctcctttagcactggagtaacatt

SEQ ID NO: 124788 - DNA, 25 bp, mus musculus
ttaggcatgagctcttggcaggagt

SEQ ID NO: 124789 - DNA, 25 bp, mus musculus
tgggctctgagcaggtgtcatattc

SEQ ID NO: 124790 - DNA, 25 bp, mus musculus
catattcattctttacaaaccatag

SEQ ID NO: 124791 - DNA, 25 bp, mus musculus
cattctttacaaaccatagagaaat

SEQ ID NO: 124792 - DNA, 25 bp, mus musculus
acttgacaatgctcaccacgtacct

SEQ ID NO: 124793 - DNA, 25 bp, mus musculus
caatgctcaccacgtacctggaggt

SEQ ID NO: 124794 - DNA, 25 bp, mus musculus
gcatgcaaaggcccgcgtagatcac

SEQ ID NO: 124795 - DNA, 25 bp, mus musculus
agatcacggggctgagatcatcaca

SEQ ID NO: 124796 - DNA, 25 bp, mus musculus
tgagatcatcacacagtccccaagc

SEQ ID NO: 124797 - DNA, 25 bp, mus musculus
cccaagcaggtccagcgtggcatca

SEQ ID NO: 124798 - DNA, 25 bp, mus musculus
cagcaacgtctcatcttctggaagc

SEQ ID NO: 124799 - DNA, 25 bp, mus musculus
atcttctggaagcatcaacctgctc

SEQ ID NO: 124800 - DNA, 25 bp, mus musculus
accataggaacttcctgcttatctc

SEQ ID NO: 124801 - DNA, 25 bp, mus musculus
ggaacttcctgcttatctcatgtta

SEQ ID NO: 124802 - DNA, 25 bp, mus musculus
acagcagacaatgctttcctttcca

SEQ ID NO: 124803 - DNA, 25 bp, mus musculus
gacaatgctttcctttccagttgtc

SEQ ID NO: 124804 - DNA, 25 bp, mus musculus
gctttcctttccagttgtctttgag

SEQ ID NO: 124805 - DNA, 25 bp, mus musculus
agcatctcgtctctcgtgttttgta

SEQ ID NO: 124806 - DNA, 25 bp, mus musculus
tcgtctctcgtgttttgtaaatact

SEQ ID NO: 124807 - DNA, 25 bp, mus musculus
agctttgaccaatttgacatagagc

SEQ ID NO: 124808 - DNA, 25 bp, mus musculus
ttgcttacaagcattgctattcaac

SEQ ID NO: 124809 - DNA, 25 bp, mus musculus
acaagcattgctattcaactcctgc

SEQ ID NO: 124810 - DNA, 25 bp, mus musculus
attgctattcaactcctgcttaagg

SEQ ID NO: 124811 - DNA, 25 bp, mus musculus
taatcttctgtgagcacactaaaag

SEQ ID NO: 124812 - DNA, 25 bp, mus musculus
tcctgcttatctcatgttagctgta

SEQ ID NO: 124813 - DNA, 25 bp, mus musculus
ttatctcatgttagctgtaccaagt

SEQ ID NO: 124814 - DNA, 25 bp, mus musculus
agctgtaccaagtcagtgattaagt

SEQ ID NO: 124815 - DNA, 25 bp, mus musculus
ttattgctggtttatgaggttaata

SEQ ID NO: 124816 - DNA, 25 bp, mus musculus
atatccttcagaagcacatgaagtt

SEQ ID NO: 124817 - DNA, 25 bp, mus musculus
aaactgcagtcatcttggacctttt

SEQ ID NO: 124818 - DNA, 25 bp, mus musculus
tttaaactcaaccaagctgtgatac

SEQ ID NO: 124819 - DNA, 25 bp, mus musculus
ctcaaccaagctgtgatacgtggaa

SEQ ID NO: 124820 - DNA, 25 bp, mus musculus
ggccctcacggcacatgcgttacgc

SEQ ID NO: 124821 - DNA, 25 bp, mus musculus
cacggcacatgcgttacgctgcctg

SEQ ID NO: 124822 - DNA, 25 bp, mus musculus
acaggcacctactgccatgaaaaca

SEQ ID NO: 124823 - DNA, 25 bp, mus musculus
ggcacctactgccatgaaaacattg

SEQ ID NO: 124824 - DNA, 25 bp, mus musculus
acctactgccatgaaaacattgacg

SEQ ID NO: 124825 - DNA, 25 bp, mus musculus
tactgccatgaaaacattgacgact

SEQ ID NO: 124826 - DNA, 25 bp, mus musculus
aacattgacgactgcatgggccagc

SEQ ID NO: 124827 - DNA, 25 bp, mus musculus
attgacgactgcatgggccagccct

SEQ ID NO: 124828 - DNA, 25 bp, mus musculus
tgccgcaacgggggcacgtgcattg

SEQ ID NO: 124829 - DNA, 25 bp, mus musculus
gtggactccttccgctgcttctgcc

SEQ ID NO: 124830 - DNA, 25 bp, mus musculus
ttctgccccagtggctgggaaggag

SEQ ID NO: 124831 - DNA, 25 bp, mus musculus
tgccccagtggctgggaaggagaac

SEQ ID NO: 124832 - DNA, 25 bp, mus musculus
ggcacatgcgttacgctgcctgggg

SEQ ID NO: 124833 - DNA, 25 bp, mus musculus
cccagtggctgggaaggagaactct

SEQ ID NO: 124834 - DNA, 25 bp, mus musculus
acatgcgttacgctgcctgggggaa

SEQ ID NO: 124835 - DNA, 25 bp, mus musculus
tgcgttacgctgcctgggggaaact

SEQ ID NO: 124836 - DNA, 25 bp, mus musculus
aacttctcctgcatctgtgacagcg

SEQ ID NO: 124837 - DNA, 25 bp, mus musculus
ttctcctgcatctgtgacagcggct

SEQ ID NO: 124838 - DNA, 25 bp, mus musculus
tgcatctgtgacagcggcttcacag

SEQ ID NO: 124839 - DNA, 25 bp, mus musculus
gacagcggcttcacaggcacctact

SEQ ID NO: 124840 - DNA, 25 bp, mus musculus
agcggcttcacaggcacctactgcc

SEQ ID NO: 124841 - DNA, 25 bp, mus musculus
tcacctcttctgctgttcagacaga

SEQ ID NO: 124842 - DNA, 25 bp, mus musculus
cttctgctgttcagacagagaacat

SEQ ID NO: 124843 - DNA, 25 bp, mus musculus
ctctggagcttttgccagcctgtga

SEQ ID NO: 124844 - DNA, 25 bp, mus musculus
agcttttgccagcctgtgaggaaat

SEQ ID NO: 124845 - DNA, 25 bp, mus musculus
gccatgcgatctggcctgtctgtag

SEQ ID NO: 124846 - DNA, 25 bp, mus musculus
cgatctggcctgtctgtagttcctg

SEQ ID NO: 124847 - DNA, 25 bp, mus musculus
ggcctgtctgtagttcctgctgaag

SEQ ID NO: 124848 - DNA, 25 bp, mus musculus
tctgtagttcctgctgaagccctgc

SEQ ID NO: 124849 - DNA, 25 bp, mus musculus
cctggtccctgagattccagaaggt

SEQ ID NO: 124850 - DNA, 25 bp, mus musculus
ttcttacaagtcacagaatgttcct

SEQ ID NO: 124851 - DNA, 25 bp, mus musculus
ccaccatcttcattaacctcaataa

SEQ ID NO: 124852 - DNA, 25 bp, mus musculus
ttaacctcaataaagacccagattg

SEQ ID NO: 124853 - DNA, 25 bp, mus musculus
caggctctagacctaactgcaagat

SEQ ID NO: 124854 - DNA, 25 bp, mus musculus
caataaagacccagattgtcaactg

SEQ ID NO: 124855 - DNA, 25 bp, mus musculus
ctagacctaactgcaagatgaaatg

SEQ ID NO: 124856 - DNA, 25 bp, mus musculus
gcccaaggcattgcatcctatgtac

SEQ ID NO: 124857 - DNA, 25 bp, mus musculus
ggcattgcatcctatgtacatcgga

SEQ ID NO: 124858 - DNA, 25 bp, mus musculus
gtctttaccagaatctcccattaca

SEQ ID NO: 124859 - DNA, 25 bp, mus musculus
accagaatctcccattacaggccct

SEQ ID NO: 124860 - DNA, 25 bp, mus musculus
atctcccattacaggccctggatca

SEQ ID NO: 124861 - DNA, 25 bp, mus musculus
cattacaggccctggatcaataaga

SEQ ID NO: 124862 - DNA, 25 bp, mus musculus
tgatacctttgatccagaacttgca

SEQ ID NO: 124863 - DNA, 25 bp, mus musculus
tgatccagaacttgcagcaacaata

SEQ ID NO: 124864 - DNA, 25 bp, mus musculus
gcattctatgttgttcatagaggca

SEQ ID NO: 124865 - DNA, 25 bp, mus musculus
tgtacagtgtgcctttgaggagctt

SEQ ID NO: 124866 - DNA, 25 bp, mus musculus
acagtgtgcctttgaggagcttgtt

SEQ ID NO: 124867 - DNA, 25 bp, mus musculus
caagctgtcacacagggaagagagc

SEQ ID NO: 124868 - DNA, 25 bp, mus musculus
ttactgctctgtgctataaactctg

SEQ ID NO: 124869 - DNA, 25 bp, mus musculus
ctgctctgtgctataaactctggga

SEQ ID NO: 124870 - DNA, 25 bp, mus musculus
ctctgtgctataaactctgggaatt

SEQ ID NO: 124871 - DNA, 25 bp, mus musculus
aactctgggaattccatctcttgca

SEQ ID NO: 124872 - DNA, 25 bp, mus musculus
atagtgacatctttctgtatataaa

SEQ ID NO: 124873 - DNA, 25 bp, mus musculus
acatctttctgtatataaactctta

SEQ ID NO: 124874 - DNA, 25 bp, mus musculus
tccagaacttgcagcaacaataggt

SEQ ID NO: 124875 - DNA, 25 bp, mus musculus
agaacttgcagcaacaataggtgtt

SEQ ID NO: 124876 - DNA, 25 bp, mus musculus
gttcagaacattaactcccagctat

SEQ ID NO: 124877 - DNA, 25 bp, mus musculus
cagaacattaactcccagctattat

SEQ ID NO: 124878 - DNA, 25 bp, mus musculus
aactcccagctattatagaggtgca

SEQ ID NO: 124879 - DNA, 25 bp, mus musculus
gaaatttgcacgcaagcattctatg

SEQ ID NO: 124880 - DNA, 25 bp, mus musculus
atttgcacgcaagcattctatgttg

SEQ ID NO: 124881 - DNA, 25 bp, mus musculus
tgcacgcaagcattctatgttgttc

SEQ ID NO: 124882 - DNA, 25 bp, mus musculus
gtatctcacgtaccctgagagaggt

SEQ ID NO: 124883 - DNA, 25 bp, mus musculus
tatctcacgtaccctgagagaggta

SEQ ID NO: 124884 - DNA, 25 bp, mus musculus
tgggcagttccacaaaggtggcatc

SEQ ID NO: 124885 - DNA, 25 bp, mus musculus
gggcagttccacaaaggtggcatca

SEQ ID NO: 124886 - DNA, 25 bp, mus musculus
cagttccacaaaggtggcatcagta

SEQ ID NO: 124887 - DNA, 25 bp, mus musculus
gttccacaaaggtggcatcagtata

SEQ ID NO: 124888 - DNA, 25 bp, mus musculus
ttccacaaaggtggcatcagtatac

SEQ ID NO: 124889 - DNA, 25 bp, mus musculus
cctgacctgcgtgcatcagagtctt

SEQ ID NO: 124890 - DNA, 25 bp, mus musculus
ctgacctgcgtgcatcagagtcttc

SEQ ID NO: 124891 - DNA, 25 bp, mus musculus
gacctgcgtgcatcagagtcttcaa

SEQ ID NO: 124892 - DNA, 25 bp, mus musculus
acctgcgtgcatcagagtcttcaag

SEQ ID NO: 124893 - DNA, 25 bp, mus musculus
cgtgcatcagagtcttcaagccaga

SEQ ID NO: 124894 - DNA, 25 bp, mus musculus
tctcacgtaccctgagagaggtaga

SEQ ID NO: 124895 - DNA, 25 bp, mus musculus
cacgtaccctgagagaggtagaact

SEQ ID NO: 124896 - DNA, 25 bp, mus musculus
acgtaccctgagagaggtagaactg

SEQ ID NO: 124897 - DNA, 25 bp, mus musculus
ttacaaggatagcctccagatctgt

SEQ ID NO: 124898 - DNA, 25 bp, mus musculus
caaggatagcctccagatctgtgtg

SEQ ID NO: 124899 - DNA, 25 bp, mus musculus
aggatagcctccagatctgtgtggg

SEQ ID NO: 124900 - DNA, 25 bp, mus musculus
ggatagcctccagatctgtgtgggc

SEQ ID NO: 124901 - DNA, 25 bp, mus musculus
gcctccagatctgtgtgggcagttc

SEQ ID NO: 124902 - DNA, 25 bp, mus musculus
cttaccactgtccaagggatcgctg

SEQ ID NO: 124903 - DNA, 25 bp, mus musculus
ttaccactgtccaagggatcgctga

SEQ ID NO: 124904 - DNA, 25 bp, mus musculus
ttgccgtgagtggtactgtaattga

SEQ ID NO: 124905 - DNA, 25 bp, mus musculus
acgatattgccagtttcctgataga

SEQ ID NO: 124906 - DNA, 25 bp, mus musculus
gatattgccagtttcctgatagagg

SEQ ID NO: 124907 - DNA, 25 bp, mus musculus
atattgccagtttcctgatagagga

SEQ ID NO: 124908 - DNA, 25 bp, mus musculus
tattgccagtttcctgatagaggat

SEQ ID NO: 124909 - DNA, 25 bp, mus musculus
attgccagtttcctgatagaggatt

SEQ ID NO: 124910 - DNA, 25 bp, mus musculus
ttgccagtttcctgatagaggattg

SEQ ID NO: 124911 - DNA, 25 bp, mus musculus
tgccagtttcctgatagaggattgg

SEQ ID NO: 124912 - DNA, 25 bp, mus musculus
gccagtttcctgatagaggattggg

SEQ ID NO: 124913 - DNA, 25 bp, mus musculus
agtttcctgatagaggattggggct

SEQ ID NO: 124914 - DNA, 25 bp, mus musculus
taccactgtccaagggatcgctgat

SEQ ID NO: 124915 - DNA, 25 bp, mus musculus
accactgtccaagggatcgctgatg

SEQ ID NO: 124916 - DNA, 25 bp, mus musculus
cactgtccaagggatcgctgatgag

SEQ ID NO: 124917 - DNA, 25 bp, mus musculus
actgtccaagggatcgctgatgagt

SEQ ID NO: 124918 - DNA, 25 bp, mus musculus
ctgtccaagggatcgctgatgagta

SEQ ID NO: 124919 - DNA, 25 bp, mus musculus
gaaatttgccgtgagtggtactgta

SEQ ID NO: 124920 - DNA, 25 bp, mus musculus
aatttgccgtgagtggtactgtaat

SEQ ID NO: 124921 - DNA, 25 bp, mus musculus
atttgccgtgagtggtactgtaatt

SEQ ID NO: 124922 - DNA, 25 bp, mus musculus
atcatcagataggtccgtcaacatt

SEQ ID NO: 124923 - DNA, 25 bp, mus musculus
ggtccgtcaacattttcgatggtgc

SEQ ID NO: 124924 - DNA, 25 bp, mus musculus
agggcaatgctcatcgcagacctca

SEQ ID NO: 124925 - DNA, 25 bp, mus musculus
gggcaatgctcatcgcagacctcag

SEQ ID NO: 124926 - DNA, 25 bp, mus musculus
ggcaatgctcatcgcagacctcaga

SEQ ID NO: 124927 - DNA, 25 bp, mus musculus
cagtatgcatagtggcctggagcta

SEQ ID NO: 124928 - DNA, 25 bp, mus musculus
agtatgcatagtggcctggagctag

SEQ ID NO: 124929 - DNA, 25 bp, mus musculus
gtatgcatagtggcctggagctaga

SEQ ID NO: 124930 - DNA, 25 bp, mus musculus
atgcatagtggcctggagctagacc

SEQ ID NO: 124931 - DNA, 25 bp, mus musculus
tgcatagtggcctggagctagacca

SEQ ID NO: 124932 - DNA, 25 bp, mus musculus
catagtggcctggagctagaccatg

SEQ ID NO: 124933 - DNA, 25 bp, mus musculus
agctagaccatgtatggcaatatcc

SEQ ID NO: 124934 - DNA, 25 bp, mus musculus
gtccgtcaacattttcgatggtgcg

SEQ ID NO: 124935 - DNA, 25 bp, mus musculus
tccgtcaacattttcgatggtgcgg

SEQ ID NO: 124936 - DNA, 25 bp, mus musculus
cgtcaacattttcgatggtgcggaa

SEQ ID NO: 124937 - DNA, 25 bp, mus musculus
gtcaacattttcgatggtgcggaat

SEQ ID NO: 124938 - DNA, 25 bp, mus musculus
tcaacattttcgatggtgcggaatg

SEQ ID NO: 124939 - DNA, 25 bp, mus musculus
aacattttcgatggtgcggaatgga

SEQ ID NO: 124940 - DNA, 25 bp, mus musculus
acattttcgatggtgcggaatggag

SEQ ID NO: 124941 - DNA, 25 bp, mus musculus
cattttcgatggtgcggaatggagg

SEQ ID NO: 124942 - DNA, 25 bp, mus musculus
gaaccgcatcatcacagcagaaggg

SEQ ID NO: 124943 - DNA, 25 bp, mus musculus
catcatcacagcagaagggatcatc

SEQ ID NO: 124944 - DNA, 25 bp, mus musculus
agatgcccagctggaaaagccatga

SEQ ID NO: 124945 - DNA, 25 bp, mus musculus
tccctgcctgccatatgtctgactc

SEQ ID NO: 124946 - DNA, 25 bp, mus musculus
atatgtctgactccagcatccctgc

SEQ ID NO: 124947 - DNA, 25 bp, mus musculus
atgagcccttaatcgctgcctctag

SEQ ID NO: 124948 - DNA, 25 bp, mus musculus
tcgctgcctctaggggagctgatta

SEQ ID NO: 124949 - DNA, 25 bp, mus musculus
ctgattacagcatcctcgttagtgt

SEQ ID NO: 124950 - DNA, 25 bp, mus musculus
acagcatcctcgttagtgtcacccc

SEQ ID NO: 124951 - DNA, 25 bp, mus musculus
ctcccagatctgtcatggccactta

SEQ ID NO: 124952 - DNA, 25 bp, mus musculus
gatctgtcatggccacttaagtgat

SEQ ID NO: 124953 - DNA, 25 bp, mus musculus
tcatggccacttaagtgataataaa

SEQ ID NO: 124954 - DNA, 25 bp, mus musculus
gatcatcttgctgttctgtgcagtg

SEQ ID NO: 124955 - DNA, 25 bp, mus musculus
cttgctgttctgtgcagtggtgcca

SEQ ID NO: 124956 - DNA, 25 bp, mus musculus
ctatgagggcctgaaccttgatgac

SEQ ID NO: 124957 - DNA, 25 bp, mus musculus
gggcctgaaccttgatgactgttct

SEQ ID NO: 124958 - DNA, 25 bp, mus musculus
gaaccttgatgactgttctatgtat

SEQ ID NO: 124959 - DNA, 25 bp, mus musculus
gggcacctaccaggatgtgggcaac

SEQ ID NO: 124960 - DNA, 25 bp, mus musculus
cctccacattggagatgcccagctg

SEQ ID NO: 124961 - DNA, 25 bp, mus musculus
cattggagatgcccagctggaaaag

SEQ ID NO: 124962 - DNA, 25 bp, mus musculus
tgacccaaactgcggccctgatgat

SEQ ID NO: 124963 - DNA, 25 bp, mus musculus
aaggagctccaggcatgccggaaag

SEQ ID NO: 124964 - DNA, 25 bp, mus musculus
tggtacatcaacatcttctgaccag

SEQ ID NO: 124965 - DNA, 25 bp, mus musculus
ggtacatcaacatcttctgaccagt

SEQ ID NO: 124966 - DNA, 25 bp, mus musculus
tacatcaacatcttctgaccagtgg

SEQ ID NO: 124967 - DNA, 25 bp, mus musculus
acatcaacatcttctgaccagtggg

SEQ ID NO: 124968 - DNA, 25 bp, mus musculus
catcaacatcttctgaccagtgggg

SEQ ID NO: 124969 - DNA, 25 bp, mus musculus
atcaacatcttctgaccagtgggga

SEQ ID NO: 124970 - DNA, 25 bp, mus musculus
caacatcttctgaccagtggggacg

SEQ ID NO: 124971 - DNA, 25 bp, mus musculus
aacatcttctgaccagtggggacgt

SEQ ID NO: 124972 - DNA, 25 bp, mus musculus
acatcttctgaccagtggggacgtg

SEQ ID NO: 124973 - DNA, 25 bp, mus musculus
catcttctgaccagtggggacgtga

SEQ ID NO: 124974 - DNA, 25 bp, mus musculus
gagctccaggcatgccggaaagagc

SEQ ID NO: 124975 - DNA, 25 bp, mus musculus
agctccaggcatgccggaaagagcg

SEQ ID NO: 124976 - DNA, 25 bp, mus musculus
gctccaggcatgccggaaagagcgc

SEQ ID NO: 124977 - DNA, 25 bp, mus musculus
ctccaggcatgccggaaagagcgca

SEQ ID NO: 124978 - DNA, 25 bp, mus musculus
acgctgacaccctgcagtctgaggg

SEQ ID NO: 124979 - DNA, 25 bp, mus musculus
cgctgacaccctgcagtctgagggc

SEQ ID NO: 124980 - DNA, 25 bp, mus musculus
tgtggtacatcaacatcttctgacc

SEQ ID NO: 124981 - DNA, 25 bp, mus musculus
gtggtacatcaacatcttctgacca

SEQ ID NO: 124982 - DNA, 25 bp, mus musculus
agacgggccttgcatctacaataat

SEQ ID NO: 124983 - DNA, 25 bp, mus musculus
cgggccttgcatctacaataatcta

SEQ ID NO: 124984 - DNA, 25 bp, mus musculus
gctgaagctgctaaccggagagctt

SEQ ID NO: 124985 - DNA, 25 bp, mus musculus
gctgctaaccggagagcttctgcct

SEQ ID NO: 124986 - DNA, 25 bp, mus musculus
gctaaccggagagcttctgcctaca

SEQ ID NO: 124987 - DNA, 25 bp, mus musculus
aaccggagagcttctgcctacagat

SEQ ID NO: 124988 - DNA, 25 bp, mus musculus
gcttctgcctacagatggaatgatc

SEQ ID NO: 124989 - DNA, 25 bp, mus musculus
tctgcctacagatggaatgatccgg

SEQ ID NO: 124990 - DNA, 25 bp, mus musculus
gatccggaagcattctcatgtcaag

SEQ ID NO: 124991 - DNA, 25 bp, mus musculus
gaagcattctcatgtcaagataggg

SEQ ID NO: 124992 - DNA, 25 bp, mus musculus
gcattctcatgtcaagatagggcgt

SEQ ID NO: 124993 - DNA, 25 bp, mus musculus
ttctcatgtcaagatagggcgttac

SEQ ID NO: 124994 - DNA, 25 bp, mus musculus
gccttgcatctacaataatctagaa

SEQ ID NO: 124995 - DNA, 25 bp, mus musculus
agggcgttaccatcagcacttacag

SEQ ID NO: 124996 - DNA, 25 bp, mus musculus
tcttgacacacgagtggctctggta

SEQ ID NO: 124997 - DNA, 25 bp, mus musculus
tgacacacgagtggctctggtagga

SEQ ID NO: 124998 - DNA, 25 bp, mus musculus
agtggctctggtaggacccaatgga

SEQ ID NO: 124999 - DNA, 25 bp, mus musculus
ggctctggtaggacccaatggagca

SEQ ID NO: 125000 - DNA, 25 bp, mus musculus
tctggtaggacccaatggagcaggg

SEQ ID NO: 125001 - DNA, 25 bp, mus musculus
agggaagtccactctgctgaagctg

SEQ ID NO: 125002 - DNA, 25 bp, mus musculus
gaagtccactctgctgaagctgcta

SEQ ID NO: 125003 - DNA, 25 bp, mus musculus
tatgactacgagggagatggctctg

SEQ ID NO: 125004 - DNA, 25 bp, mus musculus
tttgctcggctggcggacatgtatg

SEQ ID NO: 125005 - DNA, 25 bp, mus musculus
agtgcagaagccacccttagtgccc

SEQ ID NO: 125006 - DNA, 25 bp, mus musculus
gaagccacccttagtgccctgctag

SEQ ID NO: 125007 - DNA, 25 bp, mus musculus
acccttagtgccctgctagggctca

SEQ ID NO: 125008 - DNA, 25 bp, mus musculus
ctgctagggctcatcccatctttga

SEQ ID NO: 125009 - DNA, 25 bp, mus musculus
gggctcatcccatctttgattccca

SEQ ID NO: 125010 - DNA, 25 bp, mus musculus
atcccatctttgattcccagttgtg

SEQ ID NO: 125011 - DNA, 25 bp, mus musculus
tctttgattcccagttgtgactctt

SEQ ID NO: 125012 - DNA, 25 bp, mus musculus
attcccagttgtgactcttgcctct

SEQ ID NO: 125013 - DNA, 25 bp, mus musculus
agttgtgactcttgcctctgtatga

SEQ ID NO: 125014 - DNA, 25 bp, mus musculus
gactcttgcctctgtatgaaaagca

SEQ ID NO: 125015 - DNA, 25 bp, mus musculus
cggctggcggacatgtatggacatc

SEQ ID NO: 125016 - DNA, 25 bp, mus musculus
tctctcttgggatgtgcacccagaa

SEQ ID NO: 125017 - DNA, 25 bp, mus musculus
tgtgcacccagaaatcctatgaggg

SEQ ID NO: 125018 - DNA, 25 bp, mus musculus
aatcctatgagggtcaacagcatgg

SEQ ID NO: 125019 - DNA, 25 bp, mus musculus
gtcaacagcatggcccatccttggc

SEQ ID NO: 125020 - DNA, 25 bp, mus musculus
agcatggcccatccttggctccatg

SEQ ID NO: 125021 - DNA, 25 bp, mus musculus
ccttggctccatggcagataaactc

SEQ ID NO: 125022 - DNA, 25 bp, mus musculus
tggactaggcagctagagggagcac

SEQ ID NO: 125023 - DNA, 25 bp, mus musculus
ccttccgtctctttgagtccaagat

SEQ ID NO: 125024 - DNA, 25 bp, mus musculus
tctttgagtccaagatcacccaagt

SEQ ID NO: 125025 - DNA, 25 bp, mus musculus
cctccataggtcagacccgcaactt

SEQ ID NO: 125026 - DNA, 25 bp, mus musculus
gaggccttaggactctggctctctg

SEQ ID NO: 125027 - DNA, 25 bp, mus musculus
gccttaggactctggctctctgagc

SEQ ID NO: 125028 - DNA, 25 bp, mus musculus
ttaggactctggctctctgagctca

SEQ ID NO: 125029 - DNA, 25 bp, mus musculus
tggctctctgagctcagctcagggt

SEQ ID NO: 125030 - DNA, 25 bp, mus musculus
ctctctgagctcagctcagggttag

SEQ ID NO: 125031 - DNA, 25 bp, mus musculus
ttagggcctcactggattagaggct

SEQ ID NO: 125032 - DNA, 25 bp, mus musculus
gggcctcactggattagaggctctg

SEQ ID NO: 125033 - DNA, 25 bp, mus musculus
attagaggctctgctctacagggta

SEQ ID NO: 125034 - DNA, 25 bp, mus musculus
ggctctgctctacagggtaaataaa

SEQ ID NO: 125035 - DNA, 25 bp, mus musculus
ttgagtccaagatcacccaagtcct

SEQ ID NO: 125036 - DNA, 25 bp, mus musculus
ccaagatcacccaagtcctgcattt

SEQ ID NO: 125037 - DNA, 25 bp, mus musculus
agatcacccaagtcctgcatttcag

SEQ ID NO: 125038 - DNA, 25 bp, mus musculus
tcacccaagtcctgcatttcagaaa

SEQ ID NO: 125039 - DNA, 25 bp, mus musculus
aagtcctgcatttcagaaaggacac

SEQ ID NO: 125040 - DNA, 25 bp, mus musculus
gaaaggacaccatggcctccatagg

SEQ ID NO: 125041 - DNA, 25 bp, mus musculus
aggacaccatggcctccataggtca

SEQ ID NO: 125042 - DNA, 25 bp, mus musculus
tggcctccataggtcagacccgcaa

SEQ ID NO: 125043 - DNA, 25 bp, mus musculus
atgactaactttgcctttgagctag

SEQ ID NO: 125044 - DNA, 25 bp, mus musculus
gactaactttgcctttgagctagac

SEQ ID NO: 125045 - DNA, 25 bp, mus musculus
ctcagccaagactagcgtgacgagt

SEQ ID NO: 125046 - DNA, 25 bp, mus musculus
caagactagcgtgacgagtgtcacc

SEQ ID NO: 125047 - DNA, 25 bp, mus musculus
ggcaagcgcatccccttctttaaga

SEQ ID NO: 125048 - DNA, 25 bp, mus musculus
ccctatgacgtggtgccttccatga

SEQ ID NO: 125049 - DNA, 25 bp, mus musculus
ctatgacgtggtgccttccatgagg

SEQ ID NO: 125050 - DNA, 25 bp, mus musculus
tggtgccttccatgaggcccatcat

SEQ ID NO: 125051 - DNA, 25 bp, mus musculus
gtgccttccatgaggcccatcatcc

SEQ ID NO: 125052 - DNA, 25 bp, mus musculus
cttccatgaggcccatcatcctggt

SEQ ID NO: 125053 - DNA, 25 bp, mus musculus
catgaggcccatcatcctggtggga

SEQ ID NO: 125054 - DNA, 25 bp, mus musculus
ggaccgtcgctcaagggctatgagg

SEQ ID NO: 125055 - DNA, 25 bp, mus musculus
ttgcctttgagctagaccccctaga

SEQ ID NO: 125056 - DNA, 25 bp, mus musculus
accgtcgctcaagggctatgaggtg

SEQ ID NO: 125057 - DNA, 25 bp, mus musculus
gcctttgagctagaccccctagagt

SEQ ID NO: 125058 - DNA, 25 bp, mus musculus
gagctagaccccctagagttagagg

SEQ ID NO: 125059 - DNA, 25 bp, mus musculus
gctagaccccctagagttagaggag

SEQ ID NO: 125060 - DNA, 25 bp, mus musculus
agcacggcggctcagccaagactag

SEQ ID NO: 125061 - DNA, 25 bp, mus musculus
cggcggctcagccaagactagcgtg

SEQ ID NO: 125062 - DNA, 25 bp, mus musculus
gcggctcagccaagactagcgtgac

SEQ ID NO: 125063 - DNA, 25 bp, mus musculus
ggctcagccaagactagcgtgacga

SEQ ID NO: 125064 - DNA, 25 bp, mus musculus
ctgcaagtcaacactctcccactaa

SEQ ID NO: 125065 - DNA, 25 bp, mus musculus
aactttgacaaggcagaggatcaca

SEQ ID NO: 125066 - DNA, 25 bp, mus musculus
ctccaagaccagcctaacattcaga

SEQ ID NO: 125067 - DNA, 25 bp, mus musculus
gaccagcctaacattcagaggactg

SEQ ID NO: 125068 - DNA, 25 bp, mus musculus
cctaacattcagaggactgaagtga

SEQ ID NO: 125069 - DNA, 25 bp, mus musculus
gaagtgaacaccaaccatgttctaa

SEQ ID NO: 125070 - DNA, 25 bp, mus musculus
aacaccaaccatgttctaatctaca

SEQ ID NO: 125071 - DNA, 25 bp, mus musculus
aaccatgttctaatctacattgaaa

SEQ ID NO: 125072 - DNA, 25 bp, mus musculus
ttctccttcgcggtggaacaagaca

SEQ ID NO: 125073 - DNA, 25 bp, mus musculus
gaattcaccgttgaagaatacagtg

SEQ ID NO: 125074 - DNA, 25 bp, mus musculus
tacagtgcccctttcagtgatggct

SEQ ID NO: 125075 - DNA, 25 bp, mus musculus
gatgtcctcagaaggactcctccac

SEQ ID NO: 125076 - DNA, 25 bp, mus musculus
gatcacagaacattccagattcgca

SEQ ID NO: 125077 - DNA, 25 bp, mus musculus
agaacattccagattcgcatcaacg

SEQ ID NO: 125078 - DNA, 25 bp, mus musculus
ttccagattcgcatcaacgtaagct

SEQ ID NO: 125079 - DNA, 25 bp, mus musculus
gtaagctacactggagaacgaccca

SEQ ID NO: 125080 - DNA, 25 bp, mus musculus
tacactggagaacgacccagctcca

SEQ ID NO: 125081 - DNA, 25 bp, mus musculus
ggagaacgacccagctccaacatgg

SEQ ID NO: 125082 - DNA, 25 bp, mus musculus
ttcatacctatgaagccatccgtga

SEQ ID NO: 125083 - DNA, 25 bp, mus musculus
aagccatccgtgaaaaggctccaag

SEQ ID NO: 125084 - DNA, 25 bp, mus musculus
cagcagcagcagcatcctaacttat

SEQ ID NO: 125085 - DNA, 25 bp, mus musculus
cagcagcagcatcctaacttattca

SEQ ID NO: 125086 - DNA, 25 bp, mus musculus
atctcttccaaattatgtctggtct

SEQ ID NO: 125087 - DNA, 25 bp, mus musculus
tccaaattatgtctggtctgttgat

SEQ ID NO: 125088 - DNA, 25 bp, mus musculus
ttatgtctggtctgttgataatgac

SEQ ID NO: 125089 - DNA, 25 bp, mus musculus
tgtctggtctgttgataatgacagt

SEQ ID NO: 125090 - DNA, 25 bp, mus musculus
ttttcaaggtctctgtagatttcct

SEQ ID NO: 125091 - DNA, 25 bp, mus musculus
ctgtagatttccttttccatcagct

SEQ ID NO: 125092 - DNA, 25 bp, mus musculus
tagatttccttttccatcagctcac

SEQ ID NO: 125093 - DNA, 25 bp, mus musculus
atttccttttccatcagctcactaa

SEQ ID NO: 125094 - DNA, 25 bp, mus musculus
ttttccatcagctcactaatcagga

SEQ ID NO: 125095 - DNA, 25 bp, mus musculus
tccatcagctcactaatcaggaaat

SEQ ID NO: 125096 - DNA, 25 bp, mus musculus
cagcagcatcctaacttattcagca

SEQ ID NO: 125097 - DNA, 25 bp, mus musculus
catcctaacttattcagcatcatgt

SEQ ID NO: 125098 - DNA, 25 bp, mus musculus
cctaacttattcagcatcatgtctt

SEQ ID NO: 125099 - DNA, 25 bp, mus musculus
aacttattcagcatcatgtctttgg

SEQ ID NO: 125100 - DNA, 25 bp, mus musculus
atcatgtctttggaaccacttgaga

SEQ ID NO: 125101 - DNA, 25 bp, mus musculus
tctttggaaccacttgagaatctag

SEQ ID NO: 125102 - DNA, 25 bp, mus musculus
agcatcagcatctcttccaaattat

SEQ ID NO: 125103 - DNA, 25 bp, mus musculus
atcagcatctcttccaaattatgtc

SEQ ID NO: 125104 - DNA, 25 bp, mus musculus
cttctgaggcatgtggccagccgcc

SEQ ID NO: 125105 - DNA, 25 bp, mus musculus
catgtggccagccgccatcaagagg

SEQ ID NO: 125106 - DNA, 25 bp, mus musculus
ggctacaagttcacgcggcaggctc

SEQ ID NO: 125107 - DNA, 25 bp, mus musculus
aagttcacgcggcaggctcacctgc

SEQ ID NO: 125108 - DNA, 25 bp, mus musculus
caggctcacctgcggaggcacatgg

SEQ ID NO: 125109 - DNA, 25 bp, mus musculus
gctcacctgcggaggcacatggaga

SEQ ID NO: 125110 - DNA, 25 bp, mus musculus
cacctgcggaggcacatggagatcc

SEQ ID NO: 125111 - DNA, 25 bp, mus musculus
cacatggagatccacgacagagtgg

SEQ ID NO: 125112 - DNA, 25 bp, mus musculus
atccacgacagagtggagaactaca

SEQ ID NO: 125113 - DNA, 25 bp, mus musculus
aactcgcggaacctcatcattgagg

SEQ ID NO: 125114 - DNA, 25 bp, mus musculus
cggaacctcatcattgaggatgaga

SEQ ID NO: 125115 - DNA, 25 bp, mus musculus
aacctcatcattgaggatgagaaga

SEQ ID NO: 125116 - DNA, 25 bp, mus musculus
gtggccagccgccatcaagagggca

SEQ ID NO: 125117 - DNA, 25 bp, mus musculus
cacttctgccagatctgtggcaaga

SEQ ID NO: 125118 - DNA, 25 bp, mus musculus
ttctgccagatctgtggcaagacct

SEQ ID NO: 125119 - DNA, 25 bp, mus musculus
atctgtggcaagaccttcaaagctg

SEQ ID NO: 125120 - DNA, 25 bp, mus musculus
ggcaagaccttcaaagctgtggaac

SEQ ID NO: 125121 - DNA, 25 bp, mus musculus
cagttacgagtgcacgtcaggcgac

SEQ ID NO: 125122 - DNA, 25 bp, mus musculus
cgagtgcacgtcaggcgacacaaag

SEQ ID NO: 125123 - DNA, 25 bp, mus musculus
gtgcacgtcaggcgacacaaaggtg

SEQ ID NO: 125124 - DNA, 25 bp, mus musculus
tcatctacagaatattctaaaggga

SEQ ID NO: 125125 - DNA, 25 bp, mus musculus
cccctcagattggtcttaggcattt

SEQ ID NO: 125126 - DNA, 25 bp, mus musculus
ttggcttcttcaggaagttatcatg

SEQ ID NO: 125127 - DNA, 25 bp, mus musculus
atatcttctagaagcattctattag

SEQ ID NO: 125128 - DNA, 25 bp, mus musculus
tcttctagaagcattctattagaac

SEQ ID NO: 125129 - DNA, 25 bp, mus musculus
aatcaaaacttatactactattgca

SEQ ID NO: 125130 - DNA, 25 bp, mus musculus
aacttatactactattgcagctgct

SEQ ID NO: 125131 - DNA, 25 bp, mus musculus
ttatactactattgcagctgcttaa

SEQ ID NO: 125132 - DNA, 25 bp, mus musculus
tactactattgcagctgcttaaatg

SEQ ID NO: 125133 - DNA, 25 bp, mus musculus
tactattgcagctgcttaaatgcag

SEQ ID NO: 125134 - DNA, 25 bp, mus musculus
ctattgcagctgcttaaatgcagtg

SEQ ID NO: 125135 - DNA, 25 bp, mus musculus
tattgcagctgcttaaatgcagtga

SEQ ID NO: 125136 - DNA, 25 bp, mus musculus
atctcactgttttattagcgccttc

SEQ ID NO: 125137 - DNA, 25 bp, mus musculus
ctgttttattagcgccttctgtata

SEQ ID NO: 125138 - DNA, 25 bp, mus musculus
ttttattagcgccttctgtatacac

SEQ ID NO: 125139 - DNA, 25 bp, mus musculus
tattagcgccttctgtatacacagg

SEQ ID NO: 125140 - DNA, 25 bp, mus musculus
tagcgccttctgtatacacaggtgc

SEQ ID NO: 125141 - DNA, 25 bp, mus musculus
cgccttctgtatacacaggtgcagt

SEQ ID NO: 125142 - DNA, 25 bp, mus musculus
cttctgtatacacaggtgcagtgtt

SEQ ID NO: 125143 - DNA, 25 bp, mus musculus
tgcttggcttcttcaggaagttatc

SEQ ID NO: 125144 - DNA, 25 bp, mus musculus
agtgacggtccggtcctcatctcac

SEQ ID NO: 125145 - DNA, 25 bp, mus musculus
atctcaccatgcttccagaggagcg

SEQ ID NO: 125146 - DNA, 25 bp, mus musculus
gcaaaacttcccagttgccagctgc

SEQ ID NO: 125147 - DNA, 25 bp, mus musculus
aaacttcccagttgccagctgccag

SEQ ID NO: 125148 - DNA, 25 bp, mus musculus
cccagttgccagctgccagaggcag

SEQ ID NO: 125149 - DNA, 25 bp, mus musculus
agttgccagctgccagaggcagcac

SEQ ID NO: 125150 - DNA, 25 bp, mus musculus
cagctgccagaggcagcactgaact

SEQ ID NO: 125151 - DNA, 25 bp, mus musculus
gcagcactgaactgccatttcttcc

SEQ ID NO: 125152 - DNA, 25 bp, mus musculus
gcactgaactgccatttcttccctt

SEQ ID NO: 125153 - DNA, 25 bp, mus musculus
aatatgtttgttgtgctgagacttg

SEQ ID NO: 125154 - DNA, 25 bp, mus musculus
atgtttgttgtgctgagacttgtgg

SEQ ID NO: 125155 - DNA, 25 bp, mus musculus
tttgttgtgctgagacttgtgggag

SEQ ID NO: 125156 - DNA, 25 bp, mus musculus
ccatgcttccagaggagcgagtcag

SEQ ID NO: 125157 - DNA, 25 bp, mus musculus
tcagcccctggcgactcagtggtgc

SEQ ID NO: 125158 - DNA, 25 bp, mus musculus
gcccctggcgactcagtggtgcagc

SEQ ID NO: 125159 - DNA, 25 bp, mus musculus
cctggcgactcagtggtgcagctaa

SEQ ID NO: 125160 - DNA, 25 bp, mus musculus
tacagttagctgccaacaagtatta

SEQ ID NO: 125161 - DNA, 25 bp, mus musculus
agttagctgccaacaagtattaagg

SEQ ID NO: 125162 - DNA, 25 bp, mus musculus
tagctgccaacaagtattaaggatt

SEQ ID NO: 125163 - DNA, 25 bp, mus musculus
tctgcaaaacttcccagttgccagc

SEQ ID NO: 125164 - DNA, 25 bp, mus musculus
cgagccctcatcagacagcctcggg

SEQ ID NO: 125165 - DNA, 25 bp, mus musculus
ctcatcagacagcctcgggtcctac

SEQ ID NO: 125166 - DNA, 25 bp, mus musculus
atctatttctcaatggtcaacatcc

SEQ ID NO: 125167 - DNA, 25 bp, mus musculus
tatttctcaatggtcaacatccagg

SEQ ID NO: 125168 - DNA, 25 bp, mus musculus
ttctcaatggtcaacatccaggccg

SEQ ID NO: 125169 - DNA, 25 bp, mus musculus
tcaatggtcaacatccaggccggca

SEQ ID NO: 125170 - DNA, 25 bp, mus musculus
atggtcaacatccaggccggcacac

SEQ ID NO: 125171 - DNA, 25 bp, mus musculus
aacatccaggccggcacacagaact

SEQ ID NO: 125172 - DNA, 25 bp, mus musculus
atccaggccggcacacagaacttat

SEQ ID NO: 125173 - DNA, 25 bp, mus musculus
gccggcacacagaacttatgaactc

SEQ ID NO: 125174 - DNA, 25 bp, mus musculus
aacttatgaactcttgttacagtat

SEQ ID NO: 125175 - DNA, 25 bp, mus musculus
ttatgaactcttgttacagtatatt

SEQ ID NO: 125176 - DNA, 25 bp, mus musculus
atcagacagcctcgggtcctactgc

SEQ ID NO: 125177 - DNA, 25 bp, mus musculus
agacagcctcgggtcctactgctgg

SEQ ID NO: 125178 - DNA, 25 bp, mus musculus
cagcctcgggtcctactgctggatg

SEQ ID NO: 125179 - DNA, 25 bp, mus musculus
cctcgggtcctactgctggatgaag

SEQ ID NO: 125180 - DNA, 25 bp, mus musculus
cgggtcctactgctggatgaagcca

SEQ ID NO: 125181 - DNA, 25 bp, mus musculus
gtcctactgctggatgaagccacgt

SEQ ID NO: 125182 - DNA, 25 bp, mus musculus
gccacgtcagctctggatactgaga

SEQ ID NO: 125183 - DNA, 25 bp, mus musculus
ggcatctatttctcaatggtcaaca

SEQ ID NO: 125184 - DNA, 25 bp, mus musculus
ggacactgctcggtcagctgagtga

SEQ ID NO: 125185 - DNA, 25 bp, mus musculus
tgctcggtcagctgagtgatagtca

SEQ ID NO: 125186 - DNA, 25 bp, mus musculus
gatcgctttctggatggagcattcc

SEQ ID NO: 125187 - DNA, 25 bp, mus musculus
gcattcccatgaccaggaacacggg

SEQ ID NO: 125188 - DNA, 25 bp, mus musculus
gggcttcttcacatgtcttggccgt

SEQ ID NO: 125189 - DNA, 25 bp, mus musculus
cttcttcacatgtcttggccgtgat

SEQ ID NO: 125190 - DNA, 25 bp, mus musculus
cttcacatgtcttggccgtgatggg

SEQ ID NO: 125191 - DNA, 25 bp, mus musculus
atgtcttggccgtgatgggaaggta

SEQ ID NO: 125192 - DNA, 25 bp, mus musculus
tcttggccgtgatgggaaggtatat

SEQ ID NO: 125193 - DNA, 25 bp, mus musculus
atatgatcacctcaaatatgtttgg

SEQ ID NO: 125194 - DNA, 25 bp, mus musculus
tgatcacctcaaatatgtttggctg

SEQ ID NO: 125195 - DNA, 25 bp, mus musculus
tcacctcaaatatgtttggctgcag

SEQ ID NO: 125196 - DNA, 25 bp, mus musculus
gtgatagtcacgggatcgcgaccaa

SEQ ID NO: 125197 - DNA, 25 bp, mus musculus
atagtcacgggatcgcgaccaagtc

SEQ ID NO: 125198 - DNA, 25 bp, mus musculus
ggatcgcgaccaagtctgaattcct

SEQ ID NO: 125199 - DNA, 25 bp, mus musculus
ccaagtctgaattcctggaggaaag

SEQ ID NO: 125200 - DNA, 25 bp, mus musculus
agtctgaattcctggaggaaagcag

SEQ ID NO: 125201 - DNA, 25 bp, mus musculus
gatggacctaggactcctaatgtta

SEQ ID NO: 125202 - DNA, 25 bp, mus musculus
aggactcctaatgttacaggacatg

SEQ ID NO: 125203 - DNA, 25 bp, mus musculus
agagcttgatcgtgtgatcgctttc

SEQ ID NO: 125204 - DNA, 25 bp, mus musculus
ggatctagctgactctaagattgca

SEQ ID NO: 125205 - DNA, 25 bp, mus musculus
atctagctgactctaagattgcaga

SEQ ID NO: 125206 - DNA, 25 bp, mus musculus
accaggattcctgtctctatgctgt

SEQ ID NO: 125207 - DNA, 25 bp, mus musculus
caggattcctgtctctatgctgtag

SEQ ID NO: 125208 - DNA, 25 bp, mus musculus
tcctgtctctatgctgtagccggaa

SEQ ID NO: 125209 - DNA, 25 bp, mus musculus
ctgtctctatgctgtagccggaatg

SEQ ID NO: 125210 - DNA, 25 bp, mus musculus
gtctctatgctgtagccggaatgca

SEQ ID NO: 125211 - DNA, 25 bp, mus musculus
ctctatgctgtagccggaatgcaag

SEQ ID NO: 125212 - DNA, 25 bp, mus musculus
ctatgctgtagccggaatgcaagtg

SEQ ID NO: 125213 - DNA, 25 bp, mus musculus
atgctgtagccggaatgcaagtgta

SEQ ID NO: 125214 - DNA, 25 bp, mus musculus
acaatcagattgtcatggtgagatc

SEQ ID NO: 125215 - DNA, 25 bp, mus musculus
aatcagattgtcatggtgagatcat

SEQ ID NO: 125216 - DNA, 25 bp, mus musculus
agctgactctaagattgcagatttg

SEQ ID NO: 125217 - DNA, 25 bp, mus musculus
agcctcacatgctaccactgtttcc

SEQ ID NO: 125218 - DNA, 25 bp, mus musculus
cctcacatgctaccactgtttccaa

SEQ ID NO: 125219 - DNA, 25 bp, mus musculus
tcacatgctaccactgtttccaacc

SEQ ID NO: 125220 - DNA, 25 bp, mus musculus
tccaaccggtggtttcttcatgcaa

SEQ ID NO: 125221 - DNA, 25 bp, mus musculus
caaccggtggtttcttcatgcaata

SEQ ID NO: 125222 - DNA, 25 bp, mus musculus
cacttgctctcctgaccaggattcc

SEQ ID NO: 125223 - DNA, 25 bp, mus musculus
tgaccaggattcctgtctctatgct

SEQ ID NO: 125224 - DNA, 25 bp, mus musculus
acaccatgggccctgagcgtatctt

SEQ ID NO: 125225 - DNA, 25 bp, mus musculus
accatgggccctgagcgtatcttcc

SEQ ID NO: 125226 - DNA, 25 bp, mus musculus
ttagggccacatcagggtcctacag

SEQ ID NO: 125227 - DNA, 25 bp, mus musculus
ggccacatcagggtcctacagaagg

SEQ ID NO: 125228 - DNA, 25 bp, mus musculus
ccacatcagggtcctacagaaggaa

SEQ ID NO: 125229 - DNA, 25 bp, mus musculus
atcagggtcctacagaaggaactgg

SEQ ID NO: 125230 - DNA, 25 bp, mus musculus
caggcccagcaggctactcgtacca

SEQ ID NO: 125231 - DNA, 25 bp, mus musculus
ggcccagcaggctactcgtaccagc

SEQ ID NO: 125232 - DNA, 25 bp, mus musculus
agcccctcaatcaagaccctgaaca

SEQ ID NO: 125233 - DNA, 25 bp, mus musculus
cccctcaatcaagaccctgaacaag

SEQ ID NO: 125234 - DNA, 25 bp, mus musculus
tcaatcaagaccctgaacaagaaga

SEQ ID NO: 125235 - DNA, 25 bp, mus musculus
aatcaagaccctgaacaagaagagg

SEQ ID NO: 125236 - DNA, 25 bp, mus musculus
tgggccctgagcgtatcttccccaa

SEQ ID NO: 125237 - DNA, 25 bp, mus musculus
ggccctgagcgtatcttccccaatc

SEQ ID NO: 125238 - DNA, 25 bp, mus musculus
ctgagcgtatcttccccaatcagac

SEQ ID NO: 125239 - DNA, 25 bp, mus musculus
gagcgtatcttccccaatcagactg

SEQ ID NO: 125240 - DNA, 25 bp, mus musculus
atcttccccaatcagactgaggact

SEQ ID NO: 125241 - DNA, 25 bp, mus musculus
tccccaatcagactgaggacttagg

SEQ ID NO: 125242 - DNA, 25 bp, mus musculus
cccaatcagactgaggacttagggc

SEQ ID NO: 125243 - DNA, 25 bp, mus musculus
atcagactgaggacttagggccaca

SEQ ID NO: 125244 - DNA, 25 bp, mus musculus
atttcaacaacatatggtactgagt

SEQ ID NO: 125245 - DNA, 25 bp, mus musculus
tactctctgagtagcgcagatctgt

SEQ ID NO: 125246 - DNA, 25 bp, mus musculus
actcaaagcctcagcatcaagtcag

SEQ ID NO: 125247 - DNA, 25 bp, mus musculus
agcctcagcatcaagtcagaacctg

SEQ ID NO: 125248 - DNA, 25 bp, mus musculus
agcatcaagtcagaacctgtttctc

SEQ ID NO: 125249 - DNA, 25 bp, mus musculus
gacagcttgagcagctgtagcagtt

SEQ ID NO: 125250 - DNA, 25 bp, mus musculus
agctgtagcagttcctacgatggga

SEQ ID NO: 125251 - DNA, 25 bp, mus musculus
gaaagtccttcagtcaagcgcatgc

SEQ ID NO: 125252 - DNA, 25 bp, mus musculus
gtcaagcgcatgcgactctctgaag

SEQ ID NO: 125253 - DNA, 25 bp, mus musculus
cgcatgcgactctctgaaggatggg

SEQ ID NO: 125254 - DNA, 25 bp, mus musculus
cgactctctgaaggatgggcaacat

SEQ ID NO: 125255 - DNA, 25 bp, mus musculus
gcaacatgatcacattattacttaa

SEQ ID NO: 125256 - DNA, 25 bp, mus musculus
agcgcagatctgtcatctctgtctg

SEQ ID NO: 125257 - DNA, 25 bp, mus musculus
atatgcatatatgtgccgtgtgtgg

SEQ ID NO: 125258 - DNA, 25 bp, mus musculus
ctgtctggcttcaacactgccagtg

SEQ ID NO: 125259 - DNA, 25 bp, mus musculus
gtaactggctggcagcagcagcacc

SEQ ID NO: 125260 - DNA, 25 bp, mus musculus
cagcacctacataacatgccgccat

SEQ ID NO: 125261 - DNA, 25 bp, mus musculus
ggagcttgcactagcactcatttat

SEQ ID NO: 125262 - DNA, 25 bp, mus musculus
tgcactagcactcatttatctcaga

SEQ ID NO: 125263 - DNA, 25 bp, mus musculus
catttatctcagagttcaaatctct

SEQ ID NO: 125264 - DNA, 25 bp, mus musculus
ccttctactcaaagcctcagcatca

SEQ ID NO: 125265 - DNA, 25 bp, mus musculus
catagaaaccattttgtcagtctct

SEQ ID NO: 125266 - DNA, 25 bp, mus musculus
tttgtcagtctcttctgcatgttac

SEQ ID NO: 125267 - DNA, 25 bp, mus musculus
aattctaagactcttgtgtatgtct

SEQ ID NO: 125268 - DNA, 25 bp, mus musculus
aagactcttgtgtatgtctgattga

SEQ ID NO: 125269 - DNA, 25 bp, mus musculus
tgtttcttacagcacctgaacactt

SEQ ID NO: 125270 - DNA, 25 bp, mus musculus
aacacttaaccaatatgccagtgta

SEQ ID NO: 125271 - DNA, 25 bp, mus musculus
atatgccagtgtatcaacttttcaa

SEQ ID NO: 125272 - DNA, 25 bp, mus musculus
atcaacttttcaattgttactatgc

SEQ ID NO: 125273 - DNA, 25 bp, mus musculus
ttttcaattgttactatgcacaagc

SEQ ID NO: 125274 - DNA, 25 bp, mus musculus
acatagctccttgctgtcctttaaa

SEQ ID NO: 125275 - DNA, 25 bp, mus musculus
actgttacttgcttacatatgccat

SEQ ID NO: 125276 - DNA, 25 bp, mus musculus
acttgcttacatatgccatgcatag

SEQ ID NO: 125277 - DNA, 25 bp, mus musculus
agtctcttctgcatgttaccaaata

SEQ ID NO: 125278 - DNA, 25 bp, mus musculus
agacaactttggacactgagagtat

SEQ ID NO: 125279 - DNA, 25 bp, mus musculus
attacacacttatcaaactgaaagt

SEQ ID NO: 125280 - DNA, 25 bp, mus musculus
cacattaaactgcctatttgtttgt

SEQ ID NO: 125281 - DNA, 25 bp, mus musculus
aaactgcctatttgtttgtctgtat

SEQ ID NO: 125282 - DNA, 25 bp, mus musculus
tctgtattgccaagtgccaaatgga

SEQ ID NO: 125283 - DNA, 25 bp, mus musculus
cacttagagcaccactagactgagg

SEQ ID NO: 125284 - DNA, 25 bp, mus musculus
gagcaccactagactgagggattaa

SEQ ID NO: 125285 - DNA, 25 bp, mus musculus
cttgtatcagttgatgttggactgc

SEQ ID NO: 125286 - DNA, 25 bp, mus musculus
caacagacccaagttcgagcagatc

SEQ ID NO: 125287 - DNA, 25 bp, mus musculus
cattgccaagatctccacagatgac

SEQ ID NO: 125288 - DNA, 25 bp, mus musculus
caagatctccacagatgacatgaaa

SEQ ID NO: 125289 - DNA, 25 bp, mus musculus
cactgtggttgggccacagaagaag

SEQ ID NO: 125290 - DNA, 25 bp, mus musculus
cagcaccattaaagctctagaaaca

SEQ ID NO: 125291 - DNA, 25 bp, mus musculus
agctctagaaacacaatctaagaat

SEQ ID NO: 125292 - DNA, 25 bp, mus musculus
atgcagcagcatcctgcagacagat

SEQ ID NO: 125293 - DNA, 25 bp, mus musculus
cagcatcctgcagacagatggaaat

SEQ ID NO: 125294 - DNA, 25 bp, mus musculus
agaagctccaagtctaataagacac

SEQ ID NO: 125295 - DNA, 25 bp, mus musculus
tctaataagacactcagttataagt

SEQ ID NO: 125296 - DNA, 25 bp, mus musculus
tataagtccaaatgccttaaaatgg

SEQ ID NO: 125297 - DNA, 25 bp, mus musculus
actcatccggaatccaggcagtctg

SEQ ID NO: 125298 - DNA, 25 bp, mus musculus
ccggaatccaggcagtctgaagatc

SEQ ID NO: 125299 - DNA, 25 bp, mus musculus
ccttcttctggaccaaagcaatgtc

SEQ ID NO: 125300 - DNA, 25 bp, mus musculus
caatgtcgatatcgctaccttccac

SEQ ID NO: 125301 - DNA, 25 bp, mus musculus
aatcttcacaggcgtcgaatacagc

SEQ ID NO: 125302 - DNA, 25 bp, mus musculus
cgtcgaatacagctcctgtgacacc

SEQ ID NO: 125303 - DNA, 25 bp, mus musculus
atacagctcctgtgacaccattgcc

SEQ ID NO: 125304 - DNA, 25 bp, mus musculus
tgacaccattgccaagatctccaca

SEQ ID NO: 125305 - DNA, 25 bp, mus musculus
tcatcgtgactcactagctggctgc

SEQ ID NO: 125306 - DNA, 25 bp, mus musculus
tgactcactagctggctgcctgtat

SEQ ID NO: 125307 - DNA, 25 bp, mus musculus
aaacctaagcagagcccatcactgc

SEQ ID NO: 125308 - DNA, 25 bp, mus musculus
aagcagagcccatcactgccatgat

SEQ ID NO: 125309 - DNA, 25 bp, mus musculus
agcccatcactgccatgatagctgg

SEQ ID NO: 125310 - DNA, 25 bp, mus musculus
tcactgccatgatagctgggcttca

SEQ ID NO: 125311 - DNA, 25 bp, mus musculus
tagctgggcttcagtctgtctactg

SEQ ID NO: 125312 - DNA, 25 bp, mus musculus
agtctgtctactgtggtgattttta

SEQ ID NO: 125313 - DNA, 25 bp, mus musculus
agttctatctttcttccagtctaag

SEQ ID NO: 125314 - DNA, 25 bp, mus musculus
cttccagtctaagtaccaatgctat

SEQ ID NO: 125315 - DNA, 25 bp, mus musculus
tgtatagtgcctacaaattgtatga

SEQ ID NO: 125316 - DNA, 25 bp, mus musculus
accactttaatcaagatgtttatca

SEQ ID NO: 125317 - DNA, 25 bp, mus musculus
actagctggctgcctgtattgtcag

SEQ ID NO: 125318 - DNA, 25 bp, mus musculus
tggctgcctgtattgtcaggattct

SEQ ID NO: 125319 - DNA, 25 bp, mus musculus
ctcttgctggtgacctctcagtctg

SEQ ID NO: 125320 - DNA, 25 bp, mus musculus
ctggtgacctctcagtctgagaggg

SEQ ID NO: 125321 - DNA, 25 bp, mus musculus
tgtgagacccttcacaggcagtgca

SEQ ID NO: 125322 - DNA, 25 bp, mus musculus
cacaggcagtgcatgcatggaaagc

SEQ ID NO: 125323 - DNA, 25 bp, mus musculus
catgctttgctgctactgaaatgag

SEQ ID NO: 125324 - DNA, 25 bp, mus musculus
agaactcagcaattcccatcaaaaa

SEQ ID NO: 125325 - DNA, 25 bp, mus musculus
tgcaattacctgaagcttttcaggc

SEQ ID NO: 125326 - DNA, 25 bp, mus musculus
aagagccccagctggaatccttcca

SEQ ID NO: 125327 - DNA, 25 bp, mus musculus
gtaagcattctttcccttagcctgc

SEQ ID NO: 125328 - DNA, 25 bp, mus musculus
accttggtctacagtgaagtagcac

SEQ ID NO: 125329 - DNA, 25 bp, mus musculus
gcacatagcaccagcacttaatgga

SEQ ID NO: 125330 - DNA, 25 bp, mus musculus
agcaccagcacttaatggaagcttc

SEQ ID NO: 125331 - DNA, 25 bp, mus musculus
cagtgtccttgtgtgttctgaggta

SEQ ID NO: 125332 - DNA, 25 bp, mus musculus
ccttgtgtgttctgaggtattgaag

SEQ ID NO: 125333 - DNA, 25 bp, mus musculus
actatgtctaatccataagtcattt

SEQ ID NO: 125334 - DNA, 25 bp, mus musculus
tctaatccataagtcattttcttca

SEQ ID NO: 125335 - DNA, 25 bp, mus musculus
ccataagtcattttcttcaagagct

SEQ ID NO: 125336 - DNA, 25 bp, mus musculus
gtcattttcttcaagagctggatat

SEQ ID NO: 125337 - DNA, 25 bp, mus musculus
cccagctggaatccttccaatgcct

SEQ ID NO: 125338 - DNA, 25 bp, mus musculus
ccttccaatgccttgaagattattt

SEQ ID NO: 125339 - DNA, 25 bp, mus musculus
atggcaaaacctcattatgtttgtg

SEQ ID NO: 125340 - DNA, 25 bp, mus musculus
tgctccacaggctttgtaattctaa

SEQ ID NO: 125341 - DNA, 25 bp, mus musculus
gctgcccttactagggacttcttgg

SEQ ID NO: 125342 - DNA, 25 bp, mus musculus
gctttgcccccatttcttggatcat

SEQ ID NO: 125343 - DNA, 25 bp, mus musculus
tttcttggatcatgtccttagaggg

SEQ ID NO: 125344 - DNA, 25 bp, mus musculus
ggatcatgtccttagagggtaagca

SEQ ID NO: 125345 - DNA, 25 bp, mus musculus
aacatggtcagatggcctgggtgac

SEQ ID NO: 125346 - DNA, 25 bp, mus musculus
atggtcagatggcctgggtgacatg

SEQ ID NO: 125347 - DNA, 25 bp, mus musculus
gcttaggtcttttggagtgatccaa

SEQ ID NO: 125348 - DNA, 25 bp, mus musculus
tcttttggagtgatccaagggaatc

SEQ ID NO: 125349 - DNA, 25 bp, mus musculus
gggaatcctccaggttagaagctat

SEQ ID NO: 125350 - DNA, 25 bp, mus musculus
gaatcctccaggttagaagctatgc

SEQ ID NO: 125351 - DNA, 25 bp, mus musculus
aatcctccaggttagaagctatgcc

SEQ ID NO: 125352 - DNA, 25 bp, mus musculus
tcctccaggttagaagctatgccgg

SEQ ID NO: 125353 - DNA, 25 bp, mus musculus
ttccctgtcccattggcagtcggac

SEQ ID NO: 125354 - DNA, 25 bp, mus musculus
tccctgtcccattggcagtcggact

SEQ ID NO: 125355 - DNA, 25 bp, mus musculus
gtcccattggcagtcggactgcctg

SEQ ID NO: 125356 - DNA, 25 bp, mus musculus
cattggcagtcggactgcctggtgg

SEQ ID NO: 125357 - DNA, 25 bp, mus musculus
gtcagatggcctgggtgacatggtt

SEQ ID NO: 125358 - DNA, 25 bp, mus musculus
acccagtcttgtgaaagcttggtcg

SEQ ID NO: 125359 - DNA, 25 bp, mus musculus
tgaaagcttggtcgtagaggtagag

SEQ ID NO: 125360 - DNA, 25 bp, mus musculus
agaggcctcaggcaagcagatgctt

SEQ ID NO: 125361 - DNA, 25 bp, mus musculus
gaggcctcaggcaagcagatgctta

SEQ ID NO: 125362 - DNA, 25 bp, mus musculus
cagatgcttaggtcttttggagtga

SEQ ID NO: 125363 - DNA, 25 bp, mus musculus
gatgcttaggtcttttggagtgatc

SEQ ID NO: 125364 - DNA, 25 bp, mus musculus
atgcttaggtcttttggagtgatcc

SEQ ID NO: 125365 - DNA, 25 bp, mus musculus
acacacttcccaggaatcaagccta

SEQ ID NO: 125366 - DNA, 25 bp, mus musculus
ttcccaggaatcaagcctaaaattg

SEQ ID NO: 125367 - DNA, 25 bp, mus musculus
tattacatattcactctatgctcag

SEQ ID NO: 125368 - DNA, 25 bp, mus musculus
tacatattcactctatgctcagggt

SEQ ID NO: 125369 - DNA, 25 bp, mus musculus
atattcactctatgctcagggtgta

SEQ ID NO: 125370 - DNA, 25 bp, mus musculus
actctatgctcagggtgtaactatg

SEQ ID NO: 125371 - DNA, 25 bp, mus musculus
caggtcacacacacatagttacaca

SEQ ID NO: 125372 - DNA, 25 bp, mus musculus
gtcacacacacatagttacacagaa

SEQ ID NO: 125373 - DNA, 25 bp, mus musculus
ttctattcttaattttgaaagtgca

SEQ ID NO: 125374 - DNA, 25 bp, mus musculus
atggttcagaggccaactggtttat

SEQ ID NO: 125375 - DNA, 25 bp, mus musculus
agaattactctcttgtctttactga

SEQ ID NO: 125376 - DNA, 25 bp, mus musculus
attactctcttgtctttactgaaat

SEQ ID NO: 125377 - DNA, 25 bp, mus musculus
gtcctctatttcaaaagacactact

SEQ ID NO: 125378 - DNA, 25 bp, mus musculus
ctctatttcaaaagacactactaca

SEQ ID NO: 125379 - DNA, 25 bp, mus musculus
tatttcaaaagacactactacatct

SEQ ID NO: 125380 - DNA, 25 bp, mus musculus
tacatcttccaaggagcctatcaat

SEQ ID NO: 125381 - DNA, 25 bp, mus musculus
ttccaaggagcctatcaattggaat

SEQ ID NO: 125382 - DNA, 25 bp, mus musculus
gaatatgaccccctgttccgtcgtg

SEQ ID NO: 125383 - DNA, 25 bp, mus musculus
ctgttccgtcgtgtcaccaaaacat

SEQ ID NO: 125384 - DNA, 25 bp, mus musculus
ttccgtcgtgtcaccaaaacattga

SEQ ID NO: 125385 - DNA, 25 bp, mus musculus
tcccattatgacagctggaaaggag

SEQ ID NO: 125386 - DNA, 25 bp, mus musculus
atagaaatctctatcgaccatgacg

SEQ ID NO: 125387 - DNA, 25 bp, mus musculus
gatgctcttgtatcttgcttcatat

SEQ ID NO: 125388 - DNA, 25 bp, mus musculus
gctcttgtatcttgcttcatatagc

SEQ ID NO: 125389 - DNA, 25 bp, mus musculus
cttgtatcttgcttcatatagcagc

SEQ ID NO: 125390 - DNA, 25 bp, mus musculus
gtatcttgcttcatatagcagccgt

SEQ ID NO: 125391 - DNA, 25 bp, mus musculus
tcttgcttcatatagcagccgtcta

SEQ ID NO: 125392 - DNA, 25 bp, mus musculus
tgcttcatatagcagccgtctatac

SEQ ID NO: 125393 - DNA, 25 bp, mus musculus
ttcatatagcagccgtctataccag

SEQ ID NO: 125394 - DNA, 25 bp, mus musculus
atatagcagccgtctataccagacg

SEQ ID NO: 125395 - DNA, 25 bp, mus musculus
tagcagccgtctataccagacgctt

SEQ ID NO: 125396 - DNA, 25 bp, mus musculus
cagccgtctataccagacgcttctg

SEQ ID NO: 125397 - DNA, 25 bp, mus musculus
gaaatctctatcgaccatgacggag

SEQ ID NO: 125398 - DNA, 25 bp, mus musculus
gccgtctataccagacgcttctgga

SEQ ID NO: 125399 - DNA, 25 bp, mus musculus
atctctatcgaccatgacggagagg

SEQ ID NO: 125400 - DNA, 25 bp, mus musculus
tctatcgaccatgacggagaggtgc

SEQ ID NO: 125401 - DNA, 25 bp, mus musculus
atcgaccatgacggagaggtgcaca

SEQ ID NO: 125402 - DNA, 25 bp, mus musculus
agcccctgcgtcactgcaacacaga

SEQ ID NO: 125403 - DNA, 25 bp, mus musculus
ccatccagtgatgctcttgtatctt

SEQ ID NO: 125404 - DNA, 25 bp, mus musculus
tccagtgatgctcttgtatcttgct

SEQ ID NO: 125405 - DNA, 25 bp, mus musculus
agtgatgctcttgtatcttgcttca

SEQ ID NO: 125406 - DNA, 25 bp, mus musculus
tcaatatactcacttctctgcatag

SEQ ID NO: 125407 - DNA, 25 bp, mus musculus
tcacttctctgcatagcaatggtag

SEQ ID NO: 125408 - DNA, 25 bp, mus musculus
cttttgctaaagtcactctatgccg

SEQ ID NO: 125409 - DNA, 25 bp, mus musculus
ttgctaaagtcactctatgccgatt

SEQ ID NO: 125410 - DNA, 25 bp, mus musculus
ctaaagtcactctatgccgattgtg

SEQ ID NO: 125411 - DNA, 25 bp, mus musculus
ctctatgccgattgtgatcaacagt

SEQ ID NO: 125412 - DNA, 25 bp, mus musculus
gatcaacagtctgttagtgttcgat

SEQ ID NO: 125413 - DNA, 25 bp, mus musculus
gttgatcatctgcacagaatgctat

SEQ ID NO: 125414 - DNA, 25 bp, mus musculus
ttgtgtatctacatcgagctctaga

SEQ ID NO: 125415 - DNA, 25 bp, mus musculus
atctacatcgagctctagagcgcgc

SEQ ID NO: 125416 - DNA, 25 bp, mus musculus
gagctctagagcgcgcggtttgcga

SEQ ID NO: 125417 - DNA, 25 bp, mus musculus
tgatatctcgcttgacgtcactatg

SEQ ID NO: 125418 - DNA, 25 bp, mus musculus
cttctctgcatagcaatggtagact

SEQ ID NO: 125419 - DNA, 25 bp, mus musculus
ctcgcttgacgtcactatgtgtaat

SEQ ID NO: 125420 - DNA, 25 bp, mus musculus
gattcaactgagtcttgtcaatcta

SEQ ID NO: 125421 - DNA, 25 bp, mus musculus
tcaactgagtcttgtcaatctatct

SEQ ID NO: 125422 - DNA, 25 bp, mus musculus
actgagtcttgtcaatctatctgac

SEQ ID NO: 125423 - DNA, 25 bp, mus musculus
tgatgatatgtctctccaattacac

SEQ ID NO: 125424 - DNA, 25 bp, mus musculus
tgatatgtctctccaattacacttt

SEQ ID NO: 125425 - DNA, 25 bp, mus musculus
tctccaattacacttttgctaaagt

SEQ ID NO: 125426 - DNA, 25 bp, mus musculus
attacacttttgctaaagtcactct

SEQ ID NO: 125427 - DNA, 25 bp, mus musculus
ctgtgcacactggcgctccagggag

SEQ ID NO: 125428 - DNA, 25 bp, mus musculus
tgcacactggcgctccagggagctc

SEQ ID NO: 125429 - DNA, 25 bp, mus musculus
tcaacgtcctgagtaccttctcctc

SEQ ID NO: 125430 - DNA, 25 bp, mus musculus
tcctgagtaccttctcctcacttac

SEQ ID NO: 125431 - DNA, 25 bp, mus musculus
tgagtaccttctcctcacttactcc

SEQ ID NO: 125432 - DNA, 25 bp, mus musculus
cacttactccgtagctccagcttca

SEQ ID NO: 125433 - DNA, 25 bp, mus musculus
cgtagctccagcttcaccagatctc

SEQ ID NO: 125434 - DNA, 25 bp, mus musculus
agctccagcttcaccagatctcgga

SEQ ID NO: 125435 - DNA, 25 bp, mus musculus
agcttcaccagatctcggaatggac

SEQ ID NO: 125436 - DNA, 25 bp, mus musculus
gtgctgtgcctgatgtgacgaacag

SEQ ID NO: 125437 - DNA, 25 bp, mus musculus
gcgctgccaccacgtgtaaatagta

SEQ ID NO: 125438 - DNA, 25 bp, mus musculus
ctgccaccacgtgtaaatagtatcg

SEQ ID NO: 125439 - DNA, 25 bp, mus musculus
gctggagcaaccgcctgctgggtgc

SEQ ID NO: 125440 - DNA, 25 bp, mus musculus
tgcgcccggactcgtccaacgacta

SEQ ID NO: 125441 - DNA, 25 bp, mus musculus
cgtccaacgactataaagagggcag

SEQ ID NO: 125442 - DNA, 25 bp, mus musculus
ggctgtcctctaagcgtcaccacga

SEQ ID NO: 125443 - DNA, 25 bp, mus musculus
tgtcctctaagcgtcaccacgactt

SEQ ID NO: 125444 - DNA, 25 bp, mus musculus
ctaagcgtcaccacgacttcaacgt

SEQ ID NO: 125445 - DNA, 25 bp, mus musculus
agcgtcaccacgacttcaacgtcct

SEQ ID NO: 125446 - DNA, 25 bp, mus musculus
gtcaccacgacttcaacgtcctgag

SEQ ID NO: 125447 - DNA, 25 bp, mus musculus
ccgatctctcgtcgatcttcaaccg

SEQ ID NO: 125448 - DNA, 25 bp, mus musculus
cctgcgctggcgctgcaaatggcaa

SEQ ID NO: 125449 - DNA, 25 bp, mus musculus
tcgaagttgttcccaggctggaatc

SEQ ID NO: 125450 - DNA, 25 bp, mus musculus
gaagttgttcccaggctggaatctg

SEQ ID NO: 125451 - DNA, 25 bp, mus musculus
agttgttcccaggctggaatctgca

SEQ ID NO: 125452 - DNA, 25 bp, mus musculus
gttcccaggctggaatctgcaaaga

SEQ ID NO: 125453 - DNA, 25 bp, mus musculus
tcccaggctggaatctgcaaagagg

SEQ ID NO: 125454 - DNA, 25 bp, mus musculus
aaattgaagctgctgtgcttatttt

SEQ ID NO: 125455 - DNA, 25 bp, mus musculus
attgaagctgctgtgcttattttgg

SEQ ID NO: 125456 - DNA, 25 bp, mus musculus
gctgctgtgcttattttgggccgaa

SEQ ID NO: 125457 - DNA, 25 bp, mus musculus
tgctgtgcttattttgggccgaagg

SEQ ID NO: 125458 - DNA, 25 bp, mus musculus
ctatgtaaacctatagccttttgtg

SEQ ID NO: 125459 - DNA, 25 bp, mus musculus
tgcgctggcgctgcaaatggcaacc

SEQ ID NO: 125460 - DNA, 25 bp, mus musculus
cgctggcgctgcaaatggcaaccat

SEQ ID NO: 125461 - DNA, 25 bp, mus musculus
cgctgcaaatggcaaccattgaaat

SEQ ID NO: 125462 - DNA, 25 bp, mus musculus
ctgcaaatggcaaccattgaaattt

SEQ ID NO: 125463 - DNA, 25 bp, mus musculus
gttcttgtgtcccgttggctgttcg

SEQ ID NO: 125464 - DNA, 25 bp, mus musculus
tcttgtgtcccgttggctgttcgaa

SEQ ID NO: 125465 - DNA, 25 bp, mus musculus
ttgtgtcccgttggctgttcgaagt

SEQ ID NO: 125466 - DNA, 25 bp, mus musculus
gtgtcccgttggctgttcgaagttg

SEQ ID NO: 125467 - DNA, 25 bp, mus musculus
atcatactgaacaccggaggcagca

SEQ ID NO: 125468 - DNA, 25 bp, mus musculus
ctgaacaccggaggcagcatgggtg

SEQ ID NO: 125469 - DNA, 25 bp, mus musculus
atgattggcatgctgctgctcagct

SEQ ID NO: 125470 - DNA, 25 bp, mus musculus
atgctgctgctcagctcgacaaata

SEQ ID NO: 125471 - DNA, 25 bp, mus musculus
agctcgacaaatactgctgtaagca

SEQ ID NO: 125472 - DNA, 25 bp, mus musculus
actcgtcagatcaaatcatcaatta

SEQ ID NO: 125473 - DNA, 25 bp, mus musculus
aaatcatcaattaccagcgaattca

SEQ ID NO: 125474 - DNA, 25 bp, mus musculus
tcatcaattaccagcgaattcagag

SEQ ID NO: 125475 - DNA, 25 bp, mus musculus
tcaattaccagcgaattcagaggat

SEQ ID NO: 125476 - DNA, 25 bp, mus musculus
aggaacacctactgtcgagagcgtg

SEQ ID NO: 125477 - DNA, 25 bp, mus musculus
aacacctactgtcgagagcgtgaag

SEQ ID NO: 125478 - DNA, 25 bp, mus musculus
acctactgtcgagagcgtgaaggat

SEQ ID NO: 125479 - DNA, 25 bp, mus musculus
aacaccggaggcagcatgggtgaca

SEQ ID NO: 125480 - DNA, 25 bp, mus musculus
gacaatacctgctaagcaacatgga

SEQ ID NO: 125481 - DNA, 25 bp, mus musculus
aatacctgctaagcaacatggaagg

SEQ ID NO: 125482 - DNA, 25 bp, mus musculus
acctgctaagcaacatggaaggtag

SEQ ID NO: 125483 - DNA, 25 bp, mus musculus
aaggtagccgaatcggcatggagga

SEQ ID NO: 125484 - DNA, 25 bp, mus musculus
gtagccgaatcggcatggaggacgc

SEQ ID NO: 125485 - DNA, 25 bp, mus musculus
agacatggtcattcctagatgcata

SEQ ID NO: 125486 - DNA, 25 bp, mus musculus
catggtcattcctagatgcatatga

SEQ ID NO: 125487 - DNA, 25 bp, mus musculus
cgcacctacagtgtctcttttccca

SEQ ID NO: 125488 - DNA, 25 bp, mus musculus
acctacagtgtctcttttcccatgt

SEQ ID NO: 125489 - DNA, 25 bp, mus musculus
aagatcgcagtcactggcactggtg

SEQ ID NO: 125490 - DNA, 25 bp, mus musculus
agatcgcagtcactggcactggtgc

SEQ ID NO: 125491 - DNA, 25 bp, mus musculus
gatcgcagtcactggcactggtgcg

SEQ ID NO: 125492 - DNA, 25 bp, mus musculus
atcgcagtcactggcactggtgcgc

SEQ ID NO: 125493 - DNA, 25 bp, mus musculus
cgcagtcactggcactggtgcgcac

SEQ ID NO: 125494 - DNA, 25 bp, mus musculus
gcagtcactggcactggtgcgcacc

SEQ ID NO: 125495 - DNA, 25 bp, mus musculus
cagtcactggcactggtgcgcaccc

SEQ ID NO: 125496 - DNA, 25 bp, mus musculus
agtcactggcactggtgcgcaccct

SEQ ID NO: 125497 - DNA, 25 bp, mus musculus
cactggtgcgcaccctgccttcaag

SEQ ID NO: 125498 - DNA, 25 bp, mus musculus
actggtgcgcaccctgccttcaagt

SEQ ID NO: 125499 - DNA, 25 bp, mus musculus
cctacagtgtctcttttcccatgtt

SEQ ID NO: 125500 - DNA, 25 bp, mus musculus
ctacagtgtctcttttcccatgttt

SEQ ID NO: 125501 - DNA, 25 bp, mus musculus
tacagtgtctcttttcccatgttta

SEQ ID NO: 125502 - DNA, 25 bp, mus musculus
tctcttttcccatgtttaacaagat

SEQ ID NO: 125503 - DNA, 25 bp, mus musculus
tcttttcccatgtttaacaagatcg

SEQ ID NO: 125504 - DNA, 25 bp, mus musculus
ttaacaagatcgcagtcactggcac

SEQ ID NO: 125505 - DNA, 25 bp, mus musculus
taacaagatcgcagtcactggcact

SEQ ID NO: 125506 - DNA, 25 bp, mus musculus
acaagatcgcagtcactggcactgg

SEQ ID NO: 125507 - DNA, 25 bp, mus musculus
cgtagcgcatccgcttgccgggagg

SEQ ID NO: 125508 - DNA, 25 bp, mus musculus
tagcgcatccgcttgccgggaggaa

SEQ ID NO: 125509 - DNA, 25 bp, mus musculus
cacctgctcggacaaatgcaagtgc

SEQ ID NO: 125510 - DNA, 25 bp, mus musculus
cctgctcggacaaatgcaagtgcaa

SEQ ID NO: 125511 - DNA, 25 bp, mus musculus
gcaaatgcacgaactgcaagaagag

SEQ ID NO: 125512 - DNA, 25 bp, mus musculus
aaatgcacgaactgcaagaagagct

SEQ ID NO: 125513 - DNA, 25 bp, mus musculus
ccctgccggatgtgagaagtgtgcc

SEQ ID NO: 125514 - DNA, 25 bp, mus musculus
gaaatgcagctgctgccagtgagga

SEQ ID NO: 125515 - DNA, 25 bp, mus musculus
aatgcagctgctgccagtgaggacc

SEQ ID NO: 125516 - DNA, 25 bp, mus musculus
cagctgctgccagtgaggacccaga

SEQ ID NO: 125517 - DNA, 25 bp, mus musculus
tgctgccagtgaggacccagaccct

SEQ ID NO: 125518 - DNA, 25 bp, mus musculus
ccacacagcctatgtaaatagtgct

SEQ ID NO: 125519 - DNA, 25 bp, mus musculus
gcttgccgggaggaaccaagctacg

SEQ ID NO: 125520 - DNA, 25 bp, mus musculus
caagctacggcggctgctggactgg

SEQ ID NO: 125521 - DNA, 25 bp, mus musculus
tcctactggtggttcctgcacctgc

SEQ ID NO: 125522 - DNA, 25 bp, mus musculus
ctactggtggttcctgcacctgctc

SEQ ID NO: 125523 - DNA, 25 bp, mus musculus
actggtggttcctgcacctgctcgg

SEQ ID NO: 125524 - DNA, 25 bp, mus musculus
gtggttcctgcacctgctcggacaa

SEQ ID NO: 125525 - DNA, 25 bp, mus musculus
ggttcctgcacctgctcggacaaat

SEQ ID NO: 125526 - DNA, 25 bp, mus musculus
cctgcacctgctcggacaaatgcaa

SEQ ID NO: 125527 - DNA, 25 bp, mus musculus
gcccagcctggcacttcgatgtcag

SEQ ID NO: 125528 - DNA, 25 bp, mus musculus
cagcctggcacttcgatgtcagttg

SEQ ID NO: 125529 - DNA, 25 bp, mus musculus
gtcacctcagtggacctctgaatgg

SEQ ID NO: 125530 - DNA, 25 bp, mus musculus
acctcagtggacctctgaatggacc

SEQ ID NO: 125531 - DNA, 25 bp, mus musculus
tcagtggacctctgaatggacctgg

SEQ ID NO: 125532 - DNA, 25 bp, mus musculus
ctctgaatggacctggtgagaagag

SEQ ID NO: 125533 - DNA, 25 bp, mus musculus
agagttcaactcatgactcgataag

SEQ ID NO: 125534 - DNA, 25 bp, mus musculus
caactcatgactcgataagcagagc

SEQ ID NO: 125535 - DNA, 25 bp, mus musculus
ctcatgactcgataagcagagccat

SEQ ID NO: 125536 - DNA, 25 bp, mus musculus
taagcagagccatgtacagtggtcc

SEQ ID NO: 125537 - DNA, 25 bp, mus musculus
tgtacagtggtccgaggtaaaatgc

SEQ ID NO: 125538 - DNA, 25 bp, mus musculus
atgctgcagactgactatgaacgag

SEQ ID NO: 125539 - DNA, 25 bp, mus musculus
cctggcacttcgatgtcagttgaca

SEQ ID NO: 125540 - DNA, 25 bp, mus musculus
ggcacttcgatgtcagttgacaaca

SEQ ID NO: 125541 - DNA, 25 bp, mus musculus
acttcgatgtcagttgacaacagtg

SEQ ID NO: 125542 - DNA, 25 bp, mus musculus
gttgacaacagtgcaactgtaaacc

SEQ ID NO: 125543 - DNA, 25 bp, mus musculus
agtgcaactgtaaaccctcaggtct

SEQ ID NO: 125544 - DNA, 25 bp, mus musculus
ctacttctgaaaaccgtcacctcag

SEQ ID NO: 125545 - DNA, 25 bp, mus musculus
cttctgaaaaccgtcacctcagtgg

SEQ ID NO: 125546 - DNA, 25 bp, mus musculus
accgtcacctcagtggacctctgaa

SEQ ID NO: 125547 - DNA, 25 bp, mus musculus
ctgccagggcttgactcaggactga

SEQ ID NO: 125548 - DNA, 25 bp, mus musculus
cttgactcaggactgaagggagccc

SEQ ID NO: 125549 - DNA, 25 bp, mus musculus
ctcttgacccttgcactggagcctc

SEQ ID NO: 125550 - DNA, 25 bp, mus musculus
ttgacccttgcactggagcctcagt

SEQ ID NO: 125551 - DNA, 25 bp, mus musculus
acccttgcactggagcctcagttga

SEQ ID NO: 125552 - DNA, 25 bp, mus musculus
ctggagcctcagttgacaaggagac

SEQ ID NO: 125553 - DNA, 25 bp, mus musculus
acctctgctggcttgctacccaagt

SEQ ID NO: 125554 - DNA, 25 bp, mus musculus
tctgctggcttgctacccaagttaa

SEQ ID NO: 125555 - DNA, 25 bp, mus musculus
gctggcttgctacccaagttaacaa

SEQ ID NO: 125556 - DNA, 25 bp, mus musculus
ttgctacccaagttaacaagcagat

SEQ ID NO: 125557 - DNA, 25 bp, mus musculus
agattccaaaatacattcgtgttct

SEQ ID NO: 125558 - DNA, 25 bp, mus musculus
ttccaaaatacattcgtgttctcca

SEQ ID NO: 125559 - DNA, 25 bp, mus musculus
ttcctccatgttccattccgggaag

SEQ ID NO: 125560 - DNA, 25 bp, mus musculus
gtccgcttgctgtcccttgggtcac

SEQ ID NO: 125561 - DNA, 25 bp, mus musculus
tcccttgggtcaccaggtcctgcct

SEQ ID NO: 125562 - DNA, 25 bp, mus musculus
gggtcaccaggtcctgcctcctatc

SEQ ID NO: 125563 - DNA, 25 bp, mus musculus
tatctcctgagacgcctcttgaccc

SEQ ID NO: 125564 - DNA, 25 bp, mus musculus
ctcctgagacgcctcttgacccttg

SEQ ID NO: 125565 - DNA, 25 bp, mus musculus
ctgagacgcctcttgacccttgcac

SEQ ID NO: 125566 - DNA, 25 bp, mus musculus
agacgcctcttgacccttgcactgg

SEQ ID NO: 125567 - DNA, 25 bp, mus musculus
gacctgaaactggcccaagagtcca

SEQ ID NO: 125568 - DNA, 25 bp, mus musculus
cctgaaactggcccaagagtccaca

SEQ ID NO: 125569 - DNA, 25 bp, mus musculus
cgataaacagcagcttgatgagaaa

SEQ ID NO: 125570 - DNA, 25 bp, mus musculus
gtttgaaatcagcaacctgataagc

SEQ ID NO: 125571 - DNA, 25 bp, mus musculus
tttgaaatcagcaacctgataagca

SEQ ID NO: 125572 - DNA, 25 bp, mus musculus
tgaaatcagcaacctgataagcaaa

SEQ ID NO: 125573 - DNA, 25 bp, mus musculus
aatcagcaacctgataagcaaaatt

SEQ ID NO: 125574 - DNA, 25 bp, mus musculus
atcagcaacctgataagcaaaattg

SEQ ID NO: 125575 - DNA, 25 bp, mus musculus
tgtggagatccagctgcagaagaag

SEQ ID NO: 125576 - DNA, 25 bp, mus musculus
gatccagctgcagaagaagatcaaa

SEQ ID NO: 125577 - DNA, 25 bp, mus musculus
aatcgaggcagagcgggcctccagg

SEQ ID NO: 125578 - DNA, 25 bp, mus musculus
ggcctccagggccaaagcagagaag

SEQ ID NO: 125579 - DNA, 25 bp, mus musculus
ctgaaactggcccaagagtccacaa

SEQ ID NO: 125580 - DNA, 25 bp, mus musculus
gaaactggcccaagagtccacaatg

SEQ ID NO: 125581 - DNA, 25 bp, mus musculus
aaactggcccaagagtccacaatgg

SEQ ID NO: 125582 - DNA, 25 bp, mus musculus
actggcccaagagtccacaatggac

SEQ ID NO: 125583 - DNA, 25 bp, mus musculus
ggcccaagagtccacaatggacata

SEQ ID NO: 125584 - DNA, 25 bp, mus musculus
gcccaagagtccacaatggacatag

SEQ ID NO: 125585 - DNA, 25 bp, mus musculus
agagtccacaatggacatagaaaac

SEQ ID NO: 125586 - DNA, 25 bp, mus musculus
gagtccacaatggacatagaaaacg

SEQ ID NO: 125587 - DNA, 25 bp, mus musculus
ttgaatggctctcctagtcagagct

SEQ ID NO: 125588 - DNA, 25 bp, mus musculus
cctagtcagagctggctccagggag

SEQ ID NO: 125589 - DNA, 25 bp, mus musculus
atagcctagactgctacctttcaaa

SEQ ID NO: 125590 - DNA, 25 bp, mus musculus
tagactgctacctttcaaagcttgg

SEQ ID NO: 125591 - DNA, 25 bp, mus musculus
ctgtcactgggccctaggcttgggt

SEQ ID NO: 125592 - DNA, 25 bp, mus musculus
caaccagcagggtcaggacagtggc

SEQ ID NO: 125593 - DNA, 25 bp, mus musculus
tcaggacagtggctcagggtgactt

SEQ ID NO: 125594 - DNA, 25 bp, mus musculus
gtgactttcttggggcctagcacat

SEQ ID NO: 125595 - DNA, 25 bp, mus musculus
ttcttggggcctagcacatggtttg

SEQ ID NO: 125596 - DNA, 25 bp, mus musculus
gggcctagcacatggtttgtcagcc

SEQ ID NO: 125597 - DNA, 25 bp, mus musculus
gtcagcccacactggcagatgtggt

SEQ ID NO: 125598 - DNA, 25 bp, mus musculus
ccacactggcagatgtggttttgtt

SEQ ID NO: 125599 - DNA, 25 bp, mus musculus
attattctaattgctatgtattcca

SEQ ID NO: 125600 - DNA, 25 bp, mus musculus
ctaattgctatgtattccaggcagg

SEQ ID NO: 125601 - DNA, 25 bp, mus musculus
tattccaggcaggagcctgtgccca

SEQ ID NO: 125602 - DNA, 25 bp, mus musculus
ggcttaacacttcctatgcagtgct

SEQ ID NO: 125603 - DNA, 25 bp, mus musculus
acacttcctatgcagtgcttctaga

SEQ ID NO: 125604 - DNA, 25 bp, mus musculus
cctatgcagtgcttctagactttta

SEQ ID NO: 125605 - DNA, 25 bp, mus musculus
ttctagacttttatagcctagactg

SEQ ID NO: 125606 - DNA, 25 bp, mus musculus
acttttatagcctagactgctacct

SEQ ID NO: 125607 - DNA, 25 bp, mus musculus
ttggccacactctgcctcttcagga

SEQ ID NO: 125608 - DNA, 25 bp, mus musculus
acactctgcctcttcaggaggcctg

SEQ ID NO: 125609 - DNA, 25 bp, mus musculus
acaatgactcgcatgctggacctgg

SEQ ID NO: 125610 - DNA, 25 bp, mus musculus
cgcatgctggacctgggcctgtttc

SEQ ID NO: 125611 - DNA, 25 bp, mus musculus
atgctggacctgggcctgtttctgg

SEQ ID NO: 125612 - DNA, 25 bp, mus musculus
gcaggcctcctcactgtgaaaggtc

SEQ ID NO: 125613 - DNA, 25 bp, mus musculus
ctcctgcaggacagagatgctccag

SEQ ID NO: 125614 - DNA, 25 bp, mus musculus
atgtatgattctccagtcagggtcc

SEQ ID NO: 125615 - DNA, 25 bp, mus musculus
tctccagtcagggtccaagagtgga

SEQ ID NO: 125616 - DNA, 25 bp, mus musculus
cagcttgctcgacacaacatggaat

SEQ ID NO: 125617 - DNA, 25 bp, mus musculus
cttgctcgacacaacatggaatttg

SEQ ID NO: 125618 - DNA, 25 bp, mus musculus
gctcgacacaacatggaatttggct

SEQ ID NO: 125619 - DNA, 25 bp, mus musculus
ttcaggaggcctggaggtataaata

SEQ ID NO: 125620 - DNA, 25 bp, mus musculus
ccgtttggccctgtggatggcgcct

SEQ ID NO: 125621 - DNA, 25 bp, mus musculus
tttggccctgtggatggcgcctgga

SEQ ID NO: 125622 - DNA, 25 bp, mus musculus
gatggcgcctggacccactgataat

SEQ ID NO: 125623 - DNA, 25 bp, mus musculus
tggacccactgataatccccaagga

SEQ ID NO: 125624 - DNA, 25 bp, mus musculus
tgataatccccaaggacaatgactc

SEQ ID NO: 125625 - DNA, 25 bp, mus musculus
tccccaaggacaatgactcgcatgc

SEQ ID NO: 125626 - DNA, 25 bp, mus musculus
aggacaatgactcgcatgctggacc

SEQ ID NO: 125627 - DNA, 25 bp, mus musculus
cacccagcagctcagcctggcagag

SEQ ID NO: 125628 - DNA, 25 bp, mus musculus
catcctctttctcagagaaggctct

SEQ ID NO: 125629 - DNA, 25 bp, mus musculus
ctcacaccaacactgagctgctaaa

SEQ ID NO: 125630 - DNA, 25 bp, mus musculus
ccaacactgagctgctaaatctccg

SEQ ID NO: 125631 - DNA, 25 bp, mus musculus
ctgagctgctaaatctccggtctcc

SEQ ID NO: 125632 - DNA, 25 bp, mus musculus
tcacagcatgcacacacaaacctgg

SEQ ID NO: 125633 - DNA, 25 bp, mus musculus
catgcacacacaaacctggtttatg

SEQ ID NO: 125634 - DNA, 25 bp, mus musculus
cacacaaacctggtttatgtggcgt

SEQ ID NO: 125635 - DNA, 25 bp, mus musculus
aacctggtttatgtggcgttgtgat

SEQ ID NO: 125636 - DNA, 25 bp, mus musculus
aggcataggctggcatttgggtgtt

SEQ ID NO: 125637 - DNA, 25 bp, mus musculus
cataggctggcatttgggtgttcta

SEQ ID NO: 125638 - DNA, 25 bp, mus musculus
gcatttgggtgttctatgggtgttt

SEQ ID NO: 125639 - DNA, 25 bp, mus musculus
ctttctcagagaaggctctgtcggc

SEQ ID NO: 125640 - DNA, 25 bp, mus musculus
ccacctgcagctcatgaagagagga

SEQ ID NO: 125641 - DNA, 25 bp, mus musculus
ctaccgggccatggtagaggctctt

SEQ ID NO: 125642 - DNA, 25 bp, mus musculus
agactgacaaggcctctggactgca

SEQ ID NO: 125643 - DNA, 25 bp, mus musculus
acaaggcctctggactgcacactgc

SEQ ID NO: 125644 - DNA, 25 bp, mus musculus
cctctggactgcacactgcgtgctg

SEQ ID NO: 125645 - DNA, 25 bp, mus musculus
ctcctgtcctctactctgtgtgaca

SEQ ID NO: 125646 - DNA, 25 bp, mus musculus
tcctctactctgtgtgacagagaac

SEQ ID NO: 125647 - DNA, 25 bp, mus musculus
tcagtgggaccgtggtctagctttc

SEQ ID NO: 125648 - DNA, 25 bp, mus musculus
tggtctagctttcctagttccagga

SEQ ID NO: 125649 - DNA, 25 bp, mus musculus
tagtcttcagcaggttttatgaaaa

SEQ ID NO: 125650 - DNA, 25 bp, mus musculus
tcttcagcaggttttatgaaaatac

SEQ ID NO: 125651 - DNA, 25 bp, mus musculus
atgaaaatactgagcccttagtcat

SEQ ID NO: 125652 - DNA, 25 bp, mus musculus
atactgagcccttagtcatgaacta

SEQ ID NO: 125653 - DNA, 25 bp, mus musculus
ctgagcccttagtcatgaactactt

SEQ ID NO: 125654 - DNA, 25 bp, mus musculus
agcccttagtcatgaactactttag

SEQ ID NO: 125655 - DNA, 25 bp, mus musculus
ttacccactttatgtatgcttcatt

SEQ ID NO: 125656 - DNA, 25 bp, mus musculus
gtcctagccagcttttgaacacaga

SEQ ID NO: 125657 - DNA, 25 bp, mus musculus
ctagccagcttttgaacacagattt

SEQ ID NO: 125658 - DNA, 25 bp, mus musculus
tgcttgctgtgtagtaggggacatg

SEQ ID NO: 125659 - DNA, 25 bp, mus musculus
tctagctttcctagttccaggaaat

SEQ ID NO: 125660 - DNA, 25 bp, mus musculus
attattcgctaggcactctttgtaa

SEQ ID NO: 125661 - DNA, 25 bp, mus musculus
attcgctaggcactctttgtaacag

SEQ ID NO: 125662 - DNA, 25 bp, mus musculus
cgctaggcactctttgtaacagtag

SEQ ID NO: 125663 - DNA, 25 bp, mus musculus
gcactctttgtaacagtagtgtggt

SEQ ID NO: 125664 - DNA, 25 bp, mus musculus
atcattccctgtgttcattctctcc

SEQ ID NO: 125665 - DNA, 25 bp, mus musculus
attgatcattagtcttcagcaggtt

SEQ ID NO: 125666 - DNA, 25 bp, mus musculus
gatcattagtcttcagcaggtttta

SEQ ID NO: 125667 - DNA, 25 bp, mus musculus
aatctcctgagtccatcactagtat

SEQ ID NO: 125668 - DNA, 25 bp, mus musculus
ctgagtccatcactagtattgatcc

SEQ ID NO: 125669 - DNA, 25 bp, mus musculus
tcatctcagcggagacctcatcttc

SEQ ID NO: 125670 - DNA, 25 bp, mus musculus
catcttcttcagtttccagcattaa

SEQ ID NO: 125671 - DNA, 25 bp, mus musculus
cttcagtttccagcattaagcctca

SEQ ID NO: 125672 - DNA, 25 bp, mus musculus
tttccagcattaagcctcaagaatg

SEQ ID NO: 125673 - DNA, 25 bp, mus musculus
gcattaagcctcaagaatggcggca

SEQ ID NO: 125674 - DNA, 25 bp, mus musculus
aggttctctgatctaatgtctggct

SEQ ID NO: 125675 - DNA, 25 bp, mus musculus
atctatattctatcttccaccattt

SEQ ID NO: 125676 - DNA, 25 bp, mus musculus
aattcctctgtgacaaatatcacaa

SEQ ID NO: 125677 - DNA, 25 bp, mus musculus
atcacaaagttcttcctccgctgtg

SEQ ID NO: 125678 - DNA, 25 bp, mus musculus
agtcatcttctccaaactgtgtttt

SEQ ID NO: 125679 - DNA, 25 bp, mus musculus
ccatcactagtattgatcctttagt

SEQ ID NO: 125680 - DNA, 25 bp, mus musculus
agggctctcagttcttactgtgacc

SEQ ID NO: 125681 - DNA, 25 bp, mus musculus
tcttactgtgacctccttgataatt

SEQ ID NO: 125682 - DNA, 25 bp, mus musculus
ctccttgataattttgtgtgtccca

SEQ ID NO: 125683 - DNA, 25 bp, mus musculus
ggcaatgccttcagttaaagttcag

SEQ ID NO: 125684 - DNA, 25 bp, mus musculus
acagcgtctgaggctacccctttca

SEQ ID NO: 125685 - DNA, 25 bp, mus musculus
tctgaggctacccctttcagttgtt

SEQ ID NO: 125686 - DNA, 25 bp, mus musculus
agttgttcatctcagcggagacctc

SEQ ID NO: 125687 - DNA, 25 bp, mus musculus
tgtaaaggcggcactcctggggctg

SEQ ID NO: 125688 - DNA, 25 bp, mus musculus
gacttcacagtgatggttcatgact

SEQ ID NO: 125689 - DNA, 25 bp, mus musculus
ctgatgttccctgtgagcttatggg

SEQ ID NO: 125690 - DNA, 25 bp, mus musculus
attgatgatccagccaaacactggg

SEQ ID NO: 125691 - DNA, 25 bp, mus musculus
gatgatccagccaaacactggggga

SEQ ID NO: 125692 - DNA, 25 bp, mus musculus
ccagccaaacactgggggacatctg

SEQ ID NO: 125693 - DNA, 25 bp, mus musculus
gcatcctgtcagctccatgatgcct

SEQ ID NO: 125694 - DNA, 25 bp, mus musculus
ctccatgatgccttgacattcaact

SEQ ID NO: 125695 - DNA, 25 bp, mus musculus
catgatgccttgacattcaactcct

SEQ ID NO: 125696 - DNA, 25 bp, mus musculus
tcctcacttccatgccaagaataag

SEQ ID NO: 125697 - DNA, 25 bp, mus musculus
tcacttccatgccaagaataagaac

SEQ ID NO: 125698 - DNA, 25 bp, mus musculus
cttccatgccaagaataagaacttg

SEQ ID NO: 125699 - DNA, 25 bp, mus musculus
atggttcatgactctcattctctac

SEQ ID NO: 125700 - DNA, 25 bp, mus musculus
gttcatgactctcattctctaccgt

SEQ ID NO: 125701 - DNA, 25 bp, mus musculus
tctcattctctaccgtgaagacacc

SEQ ID NO: 125702 - DNA, 25 bp, mus musculus
attatgttcaggtctctcctgcgac

SEQ ID NO: 125703 - DNA, 25 bp, mus musculus
catccagagccctcagttctcttta

SEQ ID NO: 125704 - DNA, 25 bp, mus musculus
gagccctcagttctctttagacaac

SEQ ID NO: 125705 - DNA, 25 bp, mus musculus
ccctcagttctctttagacaacatt

SEQ ID NO: 125706 - DNA, 25 bp, mus musculus
cattgtctgatgttccctgtgagct

SEQ ID NO: 125707 - DNA, 25 bp, mus musculus
gcggatctcttccattgtatagact

SEQ ID NO: 125708 - DNA, 25 bp, mus musculus
cggatctcttccattgtatagacta

SEQ ID NO: 125709 - DNA, 25 bp, mus musculus
tagattacaggcttcagaggatgat

SEQ ID NO: 125710 - DNA, 25 bp, mus musculus
agattacaggcttcagaggatgatg

SEQ ID NO: 125711 - DNA, 25 bp, mus musculus
attacaggcttcagaggatgatgta

SEQ ID NO: 125712 - DNA, 25 bp, mus musculus
ttacaggcttcagaggatgatgtac

SEQ ID NO: 125713 - DNA, 25 bp, mus musculus
atgatgtacggaccactgatacgca

SEQ ID NO: 125714 - DNA, 25 bp, mus musculus
tgatgtacggaccactgatacgcat

SEQ ID NO: 125715 - DNA, 25 bp, mus musculus
gatgtacggaccactgatacgcatg

SEQ ID NO: 125716 - DNA, 25 bp, mus musculus
atgtacggaccactgatacgcatgt

SEQ ID NO: 125717 - DNA, 25 bp, mus musculus
tgtacggaccactgatacgcatgtg

SEQ ID NO: 125718 - DNA, 25 bp, mus musculus
atctgcacagtataagctgctagaa

SEQ ID NO: 125719 - DNA, 25 bp, mus musculus
ggatctcttccattgtatagactag

SEQ ID NO: 125720 - DNA, 25 bp, mus musculus
gatctcttccattgtatagactaga

SEQ ID NO: 125721 - DNA, 25 bp, mus musculus
atctcttccattgtatagactagat

SEQ ID NO: 125722 - DNA, 25 bp, mus musculus
tctcttccattgtatagactagatt

SEQ ID NO: 125723 - DNA, 25 bp, mus musculus
ctcttccattgtatagactagatta

SEQ ID NO: 125724 - DNA, 25 bp, mus musculus
tcttccattgtatagactagattac

SEQ ID NO: 125725 - DNA, 25 bp, mus musculus
actagattacaggcttcagaggatg

SEQ ID NO: 125726 - DNA, 25 bp, mus musculus
ctagattacaggcttcagaggatga

SEQ ID NO: 125727 - DNA, 25 bp, mus musculus
ccgtcagatgtcgggcaaagaccgg

SEQ ID NO: 125728 - DNA, 25 bp, mus musculus
gattgaaatcttcccttcgcgaatg

SEQ ID NO: 125729 - DNA, 25 bp, mus musculus
tgatgccttaactcttcgatttcga

SEQ ID NO: 125730 - DNA, 25 bp, mus musculus
tgccttaactcttcgatttcgacag

SEQ ID NO: 125731 - DNA, 25 bp, mus musculus
tcgatttcgacagatcctgaagaag

SEQ ID NO: 125732 - DNA, 25 bp, mus musculus
atttcgacagatcctgaagaagata

SEQ ID NO: 125733 - DNA, 25 bp, mus musculus
gagagaagctgccttctcattggct

SEQ ID NO: 125734 - DNA, 25 bp, mus musculus
agaagctgccttctcattggctgag

SEQ ID NO: 125735 - DNA, 25 bp, mus musculus
agctgccttctcattggctgaggcc

SEQ ID NO: 125736 - DNA, 25 bp, mus musculus
tgccttctcattggctgaggccaaa

SEQ ID NO: 125737 - DNA, 25 bp, mus musculus
cttctcattggctgaggccaaattc

SEQ ID NO: 125738 - DNA, 25 bp, mus musculus
ctcattggctgaggccaaattcaca

SEQ ID NO: 125739 - DNA, 25 bp, mus musculus
tgaaatcttcccttcgcgaatggca

SEQ ID NO: 125740 - DNA, 25 bp, mus musculus
tgaggccaaattcacagcaggggac

SEQ ID NO: 125741 - DNA, 25 bp, mus musculus
aatcttcccttcgcgaatggcacag

SEQ ID NO: 125742 - DNA, 25 bp, mus musculus
cttcccttcgcgaatggcacagacc

SEQ ID NO: 125743 - DNA, 25 bp, mus musculus
cccttcgcgaatggcacagaccatc

SEQ ID NO: 125744 - DNA, 25 bp, mus musculus
ttcgcgaatggcacagaccatcatg

SEQ ID NO: 125745 - DNA, 25 bp, mus musculus
gaccatcatgaaggctcgattaaaa

SEQ ID NO: 125746 - DNA, 25 bp, mus musculus
aaagtctgatgccttaactcttcga

SEQ ID NO: 125747 - DNA, 25 bp, mus musculus
gtctgatgccttaactcttcgattt

SEQ ID NO: 125748 - DNA, 25 bp, mus musculus
aggcagaaggcctccacgcacgaga

SEQ ID NO: 125749 - DNA, 25 bp, mus musculus
cagaaggcctccacgcacgagacat

SEQ ID NO: 125750 - DNA, 25 bp, mus musculus
aagcacgaggcctttgagagcgacc

SEQ ID NO: 125751 - DNA, 25 bp, mus musculus
cacgaggcctttgagagcgacctgg

SEQ ID NO: 125752 - DNA, 25 bp, mus musculus
gacctggctgcacaccaggaccgcg

SEQ ID NO: 125753 - DNA, 25 bp, mus musculus
gctgcacaccaggaccgcgtggagc

SEQ ID NO: 125754 - DNA, 25 bp, mus musculus
caggaccgcgtggagcagatcgctg

SEQ ID NO: 125755 - DNA, 25 bp, mus musculus
cagatcgctgccattgcgcaggagc

SEQ ID NO: 125756 - DNA, 25 bp, mus musculus
gctgccattgcgcaggagctcaatg

SEQ ID NO: 125757 - DNA, 25 bp, mus musculus
attgcgcaggagctcaatgaactgg

SEQ ID NO: 125758 - DNA, 25 bp, mus musculus
aacgtcaatgatcggtgccagaaaa

SEQ ID NO: 125759 - DNA, 25 bp, mus musculus
gtcaatgatcggtgccagaaaattt

SEQ ID NO: 125760 - DNA, 25 bp, mus musculus
gcctccacgcacgagacatgggctt

SEQ ID NO: 125761 - DNA, 25 bp, mus musculus
atttgcgaccagtgggatagattgg

SEQ ID NO: 125762 - DNA, 25 bp, mus musculus
acgcacgagacatgggcttatggca

SEQ ID NO: 125763 - DNA, 25 bp, mus musculus
atcttgctgcagaaggactacgagt

SEQ ID NO: 125764 - DNA, 25 bp, mus musculus
aaggactacgagtctgcgtccctga

SEQ ID NO: 125765 - DNA, 25 bp, mus musculus
gactacgagtctgcgtccctgacgg

SEQ ID NO: 125766 - DNA, 25 bp, mus musculus
cgagccctacttcggaagcacgagg

SEQ ID NO: 125767 - DNA, 25 bp, mus musculus
gccctacttcggaagcacgaggcct

SEQ ID NO: 125768 - DNA, 25 bp, mus musculus
ctacttcggaagcacgaggcctttg

SEQ ID NO: 125769 - DNA, 25 bp, mus musculus
agggttggccaggcagttagcactg

SEQ ID NO: 125770 - DNA, 25 bp, mus musculus
gcagttagcactgagccttgctccc

SEQ ID NO: 125771 - DNA, 25 bp, mus musculus
ctgtgctctacaggactcctgagct

SEQ ID NO: 125772 - DNA, 25 bp, mus musculus
tctacaggactcctgagctgagatg

SEQ ID NO: 125773 - DNA, 25 bp, mus musculus
ggactcctgagctgagatgaagtaa

SEQ ID NO: 125774 - DNA, 25 bp, mus musculus
cccgtgtctccatgccatgaaaaca

SEQ ID NO: 125775 - DNA, 25 bp, mus musculus
tctccatgccatgaaaacatgtcct

SEQ ID NO: 125776 - DNA, 25 bp, mus musculus
ccagagacactgctcttccaggacc

SEQ ID NO: 125777 - DNA, 25 bp, mus musculus
caggacctggctcctcctgattctc

SEQ ID NO: 125778 - DNA, 25 bp, mus musculus
tggagatctgtgctcctgatggctg

SEQ ID NO: 125779 - DNA, 25 bp, mus musculus
ctcctgatggctgtttatccctgac

SEQ ID NO: 125780 - DNA, 25 bp, mus musculus
gtttatccctgacccaggccttgca

SEQ ID NO: 125781 - DNA, 25 bp, mus musculus
agcactgagccttgctccctgcact

SEQ ID NO: 125782 - DNA, 25 bp, mus musculus
tgctccctgcacttactgaagcctg

SEQ ID NO: 125783 - DNA, 25 bp, mus musculus
ctgcacttactgaagcctgtgctct

SEQ ID NO: 125784 - DNA, 25 bp, mus musculus
ttactgaagcctgtgctctgaagca

SEQ ID NO: 125785 - DNA, 25 bp, mus musculus
aagcctgtgctctgaagcagcaatg

SEQ ID NO: 125786 - DNA, 25 bp, mus musculus
tctgctcactgccatgctgtaagga

SEQ ID NO: 125787 - DNA, 25 bp, mus musculus
cactgccatgctgtaaggagaggcc

SEQ ID NO: 125788 - DNA, 25 bp, mus musculus
tggaaacagccctgtcccctgtgct

SEQ ID NO: 125789 - DNA, 25 bp, mus musculus
ctcaatcatctgtcgtcatcatggt

SEQ ID NO: 125790 - DNA, 25 bp, mus musculus
tcgtcatcatggtcatcgttgctag

SEQ ID NO: 125791 - DNA, 25 bp, mus musculus
aaagtgagcagcccagggcatccct

SEQ ID NO: 125792 - DNA, 25 bp, mus musculus
agcagcccagggcatccctgaggac

SEQ ID NO: 125793 - DNA, 25 bp, mus musculus
gggcatccctgaggactgagtctcc

SEQ ID NO: 125794 - DNA, 25 bp, mus musculus
catccctgaggactgagtctcctct

SEQ ID NO: 125795 - DNA, 25 bp, mus musculus
tttctcacctgtaccacagggggat

SEQ ID NO: 125796 - DNA, 25 bp, mus musculus
ctcacctgtaccacagggggatcca

SEQ ID NO: 125797 - DNA, 25 bp, mus musculus
ggatccaggacttcttcatcccttg

SEQ ID NO: 125798 - DNA, 25 bp, mus musculus
tcttcatcccttgtggaactttagg

SEQ ID NO: 125799 - DNA, 25 bp, mus musculus
atgggcagcttcttccctattgaaa

SEQ ID NO: 125800 - DNA, 25 bp, mus musculus
gctgtacttcatgctgttaaaagtg

SEQ ID NO: 125801 - DNA, 25 bp, mus musculus
tcatcatggtcatcgttgctagtct

SEQ ID NO: 125802 - DNA, 25 bp, mus musculus
tcatcgttgctagtctggttctcct

SEQ ID NO: 125803 - DNA, 25 bp, mus musculus
tcactattgttgtggtgtgcaagag

SEQ ID NO: 125804 - DNA, 25 bp, mus musculus
atactcagactgccagcaggaacag

SEQ ID NO: 125805 - DNA, 25 bp, mus musculus
agactgccagcaggaacagtgatta

SEQ ID NO: 125806 - DNA, 25 bp, mus musculus
ttctgatgcttctttcaccatttag

SEQ ID NO: 125807 - DNA, 25 bp, mus musculus
tgatgcttctttcaccatttagaaa

SEQ ID NO: 125808 - DNA, 25 bp, mus musculus
tttcaccatttagaaagttggcatc

SEQ ID NO: 125809 - DNA, 25 bp, mus musculus
tgcccaggcggcctgtgcagacgac

SEQ ID NO: 125810 - DNA, 25 bp, mus musculus
ctgtgcagacgacttcataggggaa

SEQ ID NO: 125811 - DNA, 25 bp, mus musculus
gcacacggttcagaatgctgaccaa

SEQ ID NO: 125812 - DNA, 25 bp, mus musculus
tgaccaagttctggtgctcaagcag

SEQ ID NO: 125813 - DNA, 25 bp, mus musculus
agttctggtgctcaagcagggacgt

SEQ ID NO: 125814 - DNA, 25 bp, mus musculus
ggagcatgaccagctcagagacggc

SEQ ID NO: 125815 - DNA, 25 bp, mus musculus
agacggccaggatgtctacgcccac

SEQ ID NO: 125816 - DNA, 25 bp, mus musculus
ccaggatgtctacgcccacttggta

SEQ ID NO: 125817 - DNA, 25 bp, mus musculus
tgtctacgcccacttggtacagcag

SEQ ID NO: 125818 - DNA, 25 bp, mus musculus
gtgaggcctctagaccctgagcccc

SEQ ID NO: 125819 - DNA, 25 bp, mus musculus
ctctcaggactgtggccaggatcag

SEQ ID NO: 125820 - DNA, 25 bp, mus musculus
ggatcagacccacagggaccgtgcc

SEQ ID NO: 125821 - DNA, 25 bp, mus musculus
gaagcaacgtctggccattgcccga

SEQ ID NO: 125822 - DNA, 25 bp, mus musculus
gaacccacgggtcctcatcctggat

SEQ ID NO: 125823 - DNA, 25 bp, mus musculus
cctcatcctggatgaggctaccagc

SEQ ID NO: 125824 - DNA, 25 bp, mus musculus
ggacgcccagtgtgaacaggcccta

SEQ ID NO: 125825 - DNA, 25 bp, mus musculus
tgaacaggccctacagaactggaga

SEQ ID NO: 125826 - DNA, 25 bp, mus musculus
ggccctacagaactggagatcgcag

SEQ ID NO: 125827 - DNA, 25 bp, mus musculus
tgcccacaggctgcacacggttcag

SEQ ID NO: 125828 - DNA, 25 bp, mus musculus
caggctgcacacggttcagaatgct

SEQ ID NO: 125829 - DNA, 25 bp, mus musculus
cataccttgtggactggccgcgttg

SEQ ID NO: 125830 - DNA, 25 bp, mus musculus
actggccgcgttgcgctgtgatcag

SEQ ID NO: 125831 - DNA, 25 bp, mus musculus
gccagaccagagcttctgctaacgt

SEQ ID NO: 125832 - DNA, 25 bp, mus musculus
agaccagagcttctgctaacgtctt

SEQ ID NO: 125833 - DNA, 25 bp, mus musculus
ccagagcttctgctaacgtcttcag

SEQ ID NO: 125834 - DNA, 25 bp, mus musculus
gagcttctgctaacgtcttcagcgg

SEQ ID NO: 125835 - DNA, 25 bp, mus musculus
cttctgctaacgtcttcagcgggtt

SEQ ID NO: 125836 - DNA, 25 bp, mus musculus
ctgctaacgtcttcagcgggttgat

SEQ ID NO: 125837 - DNA, 25 bp, mus musculus
ttcagcaatgagcttcacaagcatt

SEQ ID NO: 125838 - DNA, 25 bp, mus musculus
aatgagcttcacaagcattatccaa

SEQ ID NO: 125839 - DNA, 25 bp, mus musculus
gagcttcacaagcattatccaatgg

SEQ ID NO: 125840 - DNA, 25 bp, mus musculus
cttcacaagcattatccaatggtac

SEQ ID NO: 125841 - DNA, 25 bp, mus musculus
cgcgttgcgctgtgatcagccatgg

SEQ ID NO: 125842 - DNA, 25 bp, mus musculus
gttgcgctgtgatcagccatggtcc

SEQ ID NO: 125843 - DNA, 25 bp, mus musculus
gcgctgtgatcagccatggtcctac

SEQ ID NO: 125844 - DNA, 25 bp, mus musculus
ctgtgatcagccatggtcctactcc

SEQ ID NO: 125845 - DNA, 25 bp, mus musculus
tgatcagccatggtcctactcctac

SEQ ID NO: 125846 - DNA, 25 bp, mus musculus
ctgctgctggagctgactgccagac

SEQ ID NO: 125847 - DNA, 25 bp, mus musculus
ctgactgccagaccagagcttctgc

SEQ ID NO: 125848 - DNA, 25 bp, mus musculus
actgccagaccagagcttctgctaa

SEQ ID NO: 125849 - DNA, 25 bp, mus musculus
ccggagaccaggatgccgcgcagca

SEQ ID NO: 125850 - DNA, 25 bp, mus musculus
cggagaccaggatgccgcgcagcag

SEQ ID NO: 125851 - DNA, 25 bp, mus musculus
ttcctgagtttgctcaactgagaag

SEQ ID NO: 125852 - DNA, 25 bp, mus musculus
tcctgagtttgctcaactgagaaga

SEQ ID NO: 125853 - DNA, 25 bp, mus musculus
cctgagtttgctcaactgagaagat

SEQ ID NO: 125854 - DNA, 25 bp, mus musculus
tgagtttgctcaactgagaagattt

SEQ ID NO: 125855 - DNA, 25 bp, mus musculus
gagtttgctcaactgagaagatttg

SEQ ID NO: 125856 - DNA, 25 bp, mus musculus
agtttgctcaactgagaagatttga

SEQ ID NO: 125857 - DNA, 25 bp, mus musculus
gtttgctcaactgagaagatttgag

SEQ ID NO: 125858 - DNA, 25 bp, mus musculus
tttgctcaactgagaagatttgagc

SEQ ID NO: 125859 - DNA, 25 bp, mus musculus
ttgctcaactgagaagatttgagcc

SEQ ID NO: 125860 - DNA, 25 bp, mus musculus
tgctcaactgagaagatttgagccc

SEQ ID NO: 125861 - DNA, 25 bp, mus musculus
accaggatgccgcgcagcagagctc

SEQ ID NO: 125862 - DNA, 25 bp, mus musculus
ccaggatgccgcgcagcagagctct

SEQ ID NO: 125863 - DNA, 25 bp, mus musculus
gatgccgcgcagcagagctctgatt

SEQ ID NO: 125864 - DNA, 25 bp, mus musculus
atgccgcgcagcagagctctgattc

SEQ ID NO: 125865 - DNA, 25 bp, mus musculus
tgccgcgcagcagagctctgattct

SEQ ID NO: 125866 - DNA, 25 bp, mus musculus
ccgcgcagcagagctctgattctgg

SEQ ID NO: 125867 - DNA, 25 bp, mus musculus
gcgcagcagagctctgattctgggg

SEQ ID NO: 125868 - DNA, 25 bp, mus musculus
cttcctgagtttgctcaactgagaa

SEQ ID NO: 125869 - DNA, 25 bp, mus musculus
tacacagaactagctgcacgggcat

SEQ ID NO: 125870 - DNA, 25 bp, mus musculus
acacagaactagctgcacgggcatc

SEQ ID NO: 125871 - DNA, 25 bp, mus musculus
catcatggaccaggtgatggtcagt

SEQ ID NO: 125872 - DNA, 25 bp, mus musculus
tcatggaccaggtgatggtcagtct

SEQ ID NO: 125873 - DNA, 25 bp, mus musculus
taagggtgcgctctgttagaattcg

SEQ ID NO: 125874 - DNA, 25 bp, mus musculus
ttcggcagattggagacgggtatgc

SEQ ID NO: 125875 - DNA, 25 bp, mus musculus
ggtatgctagccgactatggtgata

SEQ ID NO: 125876 - DNA, 25 bp, mus musculus
atgctagccgactatggtgataaag

SEQ ID NO: 125877 - DNA, 25 bp, mus musculus
gtattcagtatcgacgcgacgatat

SEQ ID NO: 125878 - DNA, 25 bp, mus musculus
ttcagtatcgacgcgacgatatgtc

SEQ ID NO: 125879 - DNA, 25 bp, mus musculus
cagtatcgacgcgacgatatgtcgt

SEQ ID NO: 125880 - DNA, 25 bp, mus musculus
agtatcgacgcgacgatatgtcgtt

SEQ ID NO: 125881 - DNA, 25 bp, mus musculus
acagaactagctgcacgggcatcat

SEQ ID NO: 125882 - DNA, 25 bp, mus musculus
tatcgacgcgacgatatgtcgttca

SEQ ID NO: 125883 - DNA, 25 bp, mus musculus
cagaactagctgcacgggcatcatg

SEQ ID NO: 125884 - DNA, 25 bp, mus musculus
aactagctgcacgggcatcatggac

SEQ ID NO: 125885 - DNA, 25 bp, mus musculus
ctagctgcacgggcatcatggacca

SEQ ID NO: 125886 - DNA, 25 bp, mus musculus
tagctgcacgggcatcatggaccag

SEQ ID NO: 125887 - DNA, 25 bp, mus musculus
cacgggcatcatggaccaggtgatg

SEQ ID NO: 125888 - DNA, 25 bp, mus musculus
cgggcatcatggaccaggtgatggt

SEQ ID NO: 125889 - DNA, 25 bp, mus musculus
gcatcatggaccaggtgatggtcag

SEQ ID NO: 125890 - DNA, 25 bp, mus musculus
cgtactaggtctttggcactttcag

SEQ ID NO: 125891 - DNA, 25 bp, mus musculus
ctaggtctttggcactttcagagat

SEQ ID NO: 125892 - DNA, 25 bp, mus musculus
ttaataatgccttcaaacaatcttt

SEQ ID NO: 125893 - DNA, 25 bp, mus musculus
taatgccttcaaacaatctttcctt

SEQ ID NO: 125894 - DNA, 25 bp, mus musculus
gaaaggcaaacagccactgagcagg

SEQ ID NO: 125895 - DNA, 25 bp, mus musculus
aaggcaaacagccactgagcaggat

SEQ ID NO: 125896 - DNA, 25 bp, mus musculus
ggcaaacagccactgagcaggatga

SEQ ID NO: 125897 - DNA, 25 bp, mus musculus
cagccactgagcaggatgaaaagga

SEQ ID NO: 125898 - DNA, 25 bp, mus musculus
tgaaaaggatcacaccacagcccca

SEQ ID NO: 125899 - DNA, 25 bp, mus musculus
acagccccagacatccacaggcttt

SEQ ID NO: 125900 - DNA, 25 bp, mus musculus
agacatccacaggctttccgtaagc

SEQ ID NO: 125901 - DNA, 25 bp, mus musculus
acatccacaggctttccgtaagctc

SEQ ID NO: 125902 - DNA, 25 bp, mus musculus
aggtctttggcactttcagagatat

SEQ ID NO: 125903 - DNA, 25 bp, mus musculus
gtctttggcactttcagagatatgg

SEQ ID NO: 125904 - DNA, 25 bp, mus musculus
ctttggcactttcagagatatggct

SEQ ID NO: 125905 - DNA, 25 bp, mus musculus
gagatatggctccactgccttggat

SEQ ID NO: 125906 - DNA, 25 bp, mus musculus
tatggctccactgccttggattcat

SEQ ID NO: 125907 - DNA, 25 bp, mus musculus
tggctccactgccttggattcatct

SEQ ID NO: 125908 - DNA, 25 bp, mus musculus
tccactgccttggattcatcttata

SEQ ID NO: 125909 - DNA, 25 bp, mus musculus
cactgccttggattcatcttatatt

SEQ ID NO: 125910 - DNA, 25 bp, mus musculus
tcccagagaccaggatgccgtgcag

SEQ ID NO: 125911 - DNA, 25 bp, mus musculus
cccagagaccaggatgccgtgcagc

SEQ ID NO: 125912 - DNA, 25 bp, mus musculus
atgccgtgcagcagagctctgattc

SEQ ID NO: 125913 - DNA, 25 bp, mus musculus
gccgtgcagcagagctctgattctg

SEQ ID NO: 125914 - DNA, 25 bp, mus musculus
cgtgcagcagagctctgattctggg

SEQ ID NO: 125915 - DNA, 25 bp, mus musculus
tttggccaattgatactctttgagc

SEQ ID NO: 125916 - DNA, 25 bp, mus musculus
ttggccaattgatactctttgagcc

SEQ ID NO: 125917 - DNA, 25 bp, mus musculus
tggccaattgatactctttgagccc

SEQ ID NO: 125918 - DNA, 25 bp, mus musculus
gccaattgatactctttgagcccca

SEQ ID NO: 125919 - DNA, 25 bp, mus musculus
attgatactctttgagccccaaggt

SEQ ID NO: 125920 - DNA, 25 bp, mus musculus
ttgatactctttgagccccaaggtg

SEQ ID NO: 125921 - DNA, 25 bp, mus musculus
tactctttgagccccaaggtggact

SEQ ID NO: 125922 - DNA, 25 bp, mus musculus
ccagagaccaggatgccgtgcagca

SEQ ID NO: 125923 - DNA, 25 bp, mus musculus
agagaccaggatgccgtgcagcaga

SEQ ID NO: 125924 - DNA, 25 bp, mus musculus
agaccaggatgccgtgcagcagagc

SEQ ID NO: 125925 - DNA, 25 bp, mus musculus
accaggatgccgtgcagcagagctc

SEQ ID NO: 125926 - DNA, 25 bp, mus musculus
ccaggatgccgtgcagcagagctct

SEQ ID NO: 125927 - DNA, 25 bp, mus musculus
caggatgccgtgcagcagagctctg

SEQ ID NO: 125928 - DNA, 25 bp, mus musculus
ggatgccgtgcagcagagctctgat

SEQ ID NO: 125929 - DNA, 25 bp, mus musculus
gatgccgtgcagcagagctctgatt

SEQ ID NO: 125930 - DNA, 25 bp, mus musculus
gccactcgcatcattcaggtggact

SEQ ID NO: 125931 - DNA, 25 bp, mus musculus
cactcgcatcattcaggtggactgc

SEQ ID NO: 125932 - DNA, 25 bp, mus musculus
acctctgcgtactaccgtggttcag

SEQ ID NO: 125933 - DNA, 25 bp, mus musculus
cctctgcgtactaccgtggttcagt

SEQ ID NO: 125934 - DNA, 25 bp, mus musculus
ctaccgtggttcagtgggttcactg

SEQ ID NO: 125935 - DNA, 25 bp, mus musculus
accgtggttcagtgggttcactgct

SEQ ID NO: 125936 - DNA, 25 bp, mus musculus
tgggttcactgctggtatatgacat

SEQ ID NO: 125937 - DNA, 25 bp, mus musculus
gggttcactgctggtatatgacatt

SEQ ID NO: 125938 - DNA, 25 bp, mus musculus
gttcactgctggtatatgacattgc

SEQ ID NO: 125939 - DNA, 25 bp, mus musculus
ttcactgctggtatatgacattgcc

SEQ ID NO: 125940 - DNA, 25 bp, mus musculus
tatatgacattgccaagcacttgac

SEQ ID NO: 125941 - DNA, 25 bp, mus musculus
atatgacattgccaagcacttgaca

SEQ ID NO: 125942 - DNA, 25 bp, mus musculus
actcgcatcattcaggtggactgca

SEQ ID NO: 125943 - DNA, 25 bp, mus musculus
tatgacattgccaagcacttgacat

SEQ ID NO: 125944 - DNA, 25 bp, mus musculus
ctcgcatcattcaggtggactgcaa

SEQ ID NO: 125945 - DNA, 25 bp, mus musculus
aggctcagatctgggacactgatgg

SEQ ID NO: 125946 - DNA, 25 bp, mus musculus
tagcgtgccattacctctgcgtact

SEQ ID NO: 125947 - DNA, 25 bp, mus musculus
agcgtgccattacctctgcgtacta

SEQ ID NO: 125948 - DNA, 25 bp, mus musculus
gcgtgccattacctctgcgtactac

SEQ ID NO: 125949 - DNA, 25 bp, mus musculus
tgccattacctctgcgtactaccgt

SEQ ID NO: 125950 - DNA, 25 bp, mus musculus
tacctctgcgtactaccgtggttca

SEQ ID NO: 125951 - DNA, 25 bp, mus musculus
aagacccatcaacaaattggattct

SEQ ID NO: 125952 - DNA, 25 bp, mus musculus
gaatgatccatttcagcctttccca

SEQ ID NO: 125953 - DNA, 25 bp, mus musculus
tgccagactaaatcagcaggagcaa

SEQ ID NO: 125954 - DNA, 25 bp, mus musculus
actaaatcagcaggagcaagaagac

SEQ ID NO: 125955 - DNA, 25 bp, mus musculus
cttggaactggccattgcacttagc

SEQ ID NO: 125956 - DNA, 25 bp, mus musculus
actggccattgcacttagcaaatct

SEQ ID NO: 125957 - DNA, 25 bp, mus musculus
tatctgtcctttgtcagcagtacag

SEQ ID NO: 125958 - DNA, 25 bp, mus musculus
tcctttgtcagcagtacagtgctct

SEQ ID NO: 125959 - DNA, 25 bp, mus musculus
gtgctctctggaacactgaagctat

SEQ ID NO: 125960 - DNA, 25 bp, mus musculus
aagctatttaccatgtgcatcaaac

SEQ ID NO: 125961 - DNA, 25 bp, mus musculus
atgtgcatcaaactacctatgagca

SEQ ID NO: 125962 - DNA, 25 bp, mus musculus
atcaaactacctatgagcatgggat

SEQ ID NO: 125963 - DNA, 25 bp, mus musculus
tcagcctttcccaggcaatgatagt

SEQ ID NO: 125964 - DNA, 25 bp, mus musculus
tttcccaggcaatgatagtcccaaa

SEQ ID NO: 125965 - DNA, 25 bp, mus musculus
agatcctgatatgttttgtgatcca

SEQ ID NO: 125966 - DNA, 25 bp, mus musculus
ttcttctaccactaccaataaagag

SEQ ID NO: 125967 - DNA, 25 bp, mus musculus
taccactaccaataaagaggctgac

SEQ ID NO: 125968 - DNA, 25 bp, mus musculus
ggctgacccaagcaattttgctaac

SEQ ID NO: 125969 - DNA, 25 bp, mus musculus
tgctaacttcagtgcttatccctct

SEQ ID NO: 125970 - DNA, 25 bp, mus musculus
tgcttatccctctgaagaagatatg

SEQ ID NO: 125971 - DNA, 25 bp, mus musculus
ctgatcctcctggctgcgtcacaag

SEQ ID NO: 125972 - DNA, 25 bp, mus musculus
gatcctcctggctgcgtcacaaggc

SEQ ID NO: 125973 - DNA, 25 bp, mus musculus
catagctgtgggctacctggatgac

SEQ ID NO: 125974 - DNA, 25 bp, mus musculus
ctcagttcgtgcgcttcaacagctc

SEQ ID NO: 125975 - DNA, 25 bp, mus musculus
cagttcgtgcgcttcaacagctcag

SEQ ID NO: 125976 - DNA, 25 bp, mus musculus
gcttcaacagctcaggggagactgc

SEQ ID NO: 125977 - DNA, 25 bp, mus musculus
ttcaacagctcaggggagactgcga

SEQ ID NO: 125978 - DNA, 25 bp, mus musculus
caacagctcaggggagactgcgaca

SEQ ID NO: 125979 - DNA, 25 bp, mus musculus
actgcgacatataagctaagtgcgc

SEQ ID NO: 125980 - DNA, 25 bp, mus musculus
atgtatggctgtgaggtggagttct

SEQ ID NO: 125981 - DNA, 25 bp, mus musculus
gtatggctgtgaggtggagttcttc

SEQ ID NO: 125982 - DNA, 25 bp, mus musculus
tcttcgggagcctcttccgcgctta

SEQ ID NO: 125983 - DNA, 25 bp, mus musculus
tcctcctggctgcgtcacaaggcca

SEQ ID NO: 125984 - DNA, 25 bp, mus musculus
ctcctggctgcgtcacaaggccaga

SEQ ID NO: 125985 - DNA, 25 bp, mus musculus
cctggctgcgtcacaaggccagacc

SEQ ID NO: 125986 - DNA, 25 bp, mus musculus
tggctgcgtcacaaggccagaccca

SEQ ID NO: 125987 - DNA, 25 bp, mus musculus
gctgcgtcacaaggccagacccaga

SEQ ID NO: 125988 - DNA, 25 bp, mus musculus
tgcgtcacaaggccagacccagacc

SEQ ID NO: 125989 - DNA, 25 bp, mus musculus
cgtcacaaggccagacccagacctg

SEQ ID NO: 125990 - DNA, 25 bp, mus musculus
ctgcccaggctcacactcgctgagg

SEQ ID NO: 125991 - DNA, 25 bp, mus musculus
cagcattatgtctcaggctaagtat

SEQ ID NO: 125992 - DNA, 25 bp, mus musculus
gcattatgtctcaggctaagtatga

SEQ ID NO: 125993 - DNA, 25 bp, mus musculus
ctcaaggctaaaccaacgtgatact

SEQ ID NO: 125994 - DNA, 25 bp, mus musculus
caaggctaaaccaacgtgatactcg

SEQ ID NO: 125995 - DNA, 25 bp, mus musculus
gctaaaccaacgtgatactcgtgga

SEQ ID NO: 125996 - DNA, 25 bp, mus musculus
ccaacgtgatactcgtggaacaagc

SEQ ID NO: 125997 - DNA, 25 bp, mus musculus
cgtgatactcgtggaacaagctgag

SEQ ID NO: 125998 - DNA, 25 bp, mus musculus
atactcgtggaacaagctgagagcg

SEQ ID NO: 125999 - DNA, 25 bp, mus musculus
agctgagagcgacttccaaggtaag

SEQ ID NO: 126000 - DNA, 25 bp, mus musculus
ctgagagcgacttccaaggtaagtg

SEQ ID NO: 126001 - DNA, 25 bp, mus musculus
tttagatcgaacagaccttgagtcc

SEQ ID NO: 126002 - DNA, 25 bp, mus musculus
tagatcgaacagaccttgagtccag

SEQ ID NO: 126003 - DNA, 25 bp, mus musculus
tatgtctcaggctaagtatgacaaa

SEQ ID NO: 126004 - DNA, 25 bp, mus musculus
tcgaacagaccttgagtccagcaca

SEQ ID NO: 126005 - DNA, 25 bp, mus musculus
tgacaaagtggctgagcaggtgaac

SEQ ID NO: 126006 - DNA, 25 bp, mus musculus
cagccacgagactcaggtaactgat

SEQ ID NO: 126007 - DNA, 25 bp, mus musculus
gagatccggttcatctacactcacc

SEQ ID NO: 126008 - DNA, 25 bp, mus musculus
tccggttcatctacactcacctcaa

SEQ ID NO: 126009 - DNA, 25 bp, mus musculus
atattggcaggtgctcttggacctc

SEQ ID NO: 126010 - DNA, 25 bp, mus musculus
aggtgctcttggacctcaaggctaa

SEQ ID NO: 126011 - DNA, 25 bp, mus musculus
gtgctcttggacctcaaggctaaac

SEQ ID NO: 126012 - DNA, 25 bp, mus musculus
tataaaagcacactaagtgggcact

SEQ ID NO: 126013 - DNA, 25 bp, mus musculus
gcccctgttctggcctgtgcttttt

SEQ ID NO: 126014 - DNA, 25 bp, mus musculus
actcagcataccaggtatgttacga

SEQ ID NO: 126015 - DNA, 25 bp, mus musculus
acttgtgcgtttgccccaacactct

SEQ ID NO: 126016 - DNA, 25 bp, mus musculus
tgtgcgtttgccccaacactctctt

SEQ ID NO: 126017 - DNA, 25 bp, mus musculus
ccaacactctcttacttgctactgg

SEQ ID NO: 126018 - DNA, 25 bp, mus musculus
acactctcttacttgctactggttc

SEQ ID NO: 126019 - DNA, 25 bp, mus musculus
tacttgctactggttcaatggacaa

SEQ ID NO: 126020 - DNA, 25 bp, mus musculus
ttgctactggttcaatggacaagac

SEQ ID NO: 126021 - DNA, 25 bp, mus musculus
ttgacctggaaacaccttgccaagc

SEQ ID NO: 126022 - DNA, 25 bp, mus musculus
acctggaaacaccttgccaagcagg

SEQ ID NO: 126023 - DNA, 25 bp, mus musculus
tggaaacaccttgccaagcaggaag

SEQ ID NO: 126024 - DNA, 25 bp, mus musculus
ctggcctgtgctttttcacatgatg

SEQ ID NO: 126025 - DNA, 25 bp, mus musculus
caccttgccaagcaggaagcatgaa

SEQ ID NO: 126026 - DNA, 25 bp, mus musculus
aagatgcttgcatcggggtcagtgg

SEQ ID NO: 126027 - DNA, 25 bp, mus musculus
gataaatctgtcatcatacatggta

SEQ ID NO: 126028 - DNA, 25 bp, mus musculus
gtcatcatacatggtatcggccctc

SEQ ID NO: 126029 - DNA, 25 bp, mus musculus
catggtatcggccctcagagtgtgc

SEQ ID NO: 126030 - DNA, 25 bp, mus musculus
ggtatcggccctcagagtgtgctac

SEQ ID NO: 126031 - DNA, 25 bp, mus musculus
atcggccctcagagtgtgctacaca

SEQ ID NO: 126032 - DNA, 25 bp, mus musculus
cacacgctgactcagcataccaggt

SEQ ID NO: 126033 - DNA, 25 bp, mus musculus
cagtcgtcagcatggctcgctcggt

SEQ ID NO: 126034 - DNA, 25 bp, mus musculus
tggctcgctcggtgaccctggtctt

SEQ ID NO: 126035 - DNA, 25 bp, mus musculus
gtatgctatccagaaaacccctcaa

SEQ ID NO: 126036 - DNA, 25 bp, mus musculus
ccctcaaattcaagtatactcacgc

SEQ ID NO: 126037 - DNA, 25 bp, mus musculus
ctcaaattcaagtatactcacgcca

SEQ ID NO: 126038 - DNA, 25 bp, mus musculus
ccgaacatactgaactgctacgtaa

SEQ ID NO: 126039 - DNA, 25 bp, mus musculus
gaacatactgaactgctacgtaaca

SEQ ID NO: 126040 - DNA, 25 bp, mus musculus
acatactgaactgctacgtaacaca

SEQ ID NO: 126041 - DNA, 25 bp, mus musculus
atactgaactgctacgtaacacagt

SEQ ID NO: 126042 - DNA, 25 bp, mus musculus
ctgctacgtaacacagttccacccg

SEQ ID NO: 126043 - DNA, 25 bp, mus musculus
ccgcctcacattgaaatccaaatgc

SEQ ID NO: 126044 - DNA, 25 bp, mus musculus
cattgaaatccaaatgctgaagaac

SEQ ID NO: 126045 - DNA, 25 bp, mus musculus
tgaccctggtctttctggtgcttgt

SEQ ID NO: 126046 - DNA, 25 bp, mus musculus
gtctttctggtgcttgtctcactga

SEQ ID NO: 126047 - DNA, 25 bp, mus musculus
ggtgcttgtctcactgaccggcctg

SEQ ID NO: 126048 - DNA, 25 bp, mus musculus
cttgtctcactgaccggcctgtatg

SEQ ID NO: 126049 - DNA, 25 bp, mus musculus
tcactgaccggcctgtatgctatcc

SEQ ID NO: 126050 - DNA, 25 bp, mus musculus
actgaccggcctgtatgctatccag

SEQ ID NO: 126051 - DNA, 25 bp, mus musculus
tgaccggcctgtatgctatccagaa

SEQ ID NO: 126052 - DNA, 25 bp, mus musculus
cggcctgtatgctatccagaaaacc

SEQ ID NO: 126053 - DNA, 25 bp, mus musculus
gtgccagctgagacgctctacgatg

SEQ ID NO: 126054 - DNA, 25 bp, mus musculus
gagacgctctacgatgtcctgcatg

SEQ ID NO: 126055 - DNA, 25 bp, mus musculus
actgtcaacgctgacgtaggatatt

SEQ ID NO: 126056 - DNA, 25 bp, mus musculus
gtcaacgctgacgtaggatattatt

SEQ ID NO: 126057 - DNA, 25 bp, mus musculus
tgtcccaagcccctgaagaaccgtg

SEQ ID NO: 126058 - DNA, 25 bp, mus musculus
cccaagcccctgaagaaccgtgatg

SEQ ID NO: 126059 - DNA, 25 bp, mus musculus
cccctgaagaaccgtgatgtcatca

SEQ ID NO: 126060 - DNA, 25 bp, mus musculus
tggctccccatgggcgctgattaca

SEQ ID NO: 126061 - DNA, 25 bp, mus musculus
ctccccatgggcgctgattacatca

SEQ ID NO: 126062 - DNA, 25 bp, mus musculus
cccatgggcgctgattacatcatta

SEQ ID NO: 126063 - DNA, 25 bp, mus musculus
atcattatgaactactcagtgaaac

SEQ ID NO: 126064 - DNA, 25 bp, mus musculus
attatgaactactcagtgaaacacc

SEQ ID NO: 126065 - DNA, 25 bp, mus musculus
acgctctacgatgtcctgcatgaca

SEQ ID NO: 126066 - DNA, 25 bp, mus musculus
ctctacgatgtcctgcatgacatag

SEQ ID NO: 126067 - DNA, 25 bp, mus musculus
gatgtcctgcatgacatagaataca

SEQ ID NO: 126068 - DNA, 25 bp, mus musculus
attgagactttcgacatcgcccgct

SEQ ID NO: 126069 - DNA, 25 bp, mus musculus
gacatcgcccgcttgactgtcaacg

SEQ ID NO: 126070 - DNA, 25 bp, mus musculus
atcgcccgcttgactgtcaacgctg

SEQ ID NO: 126071 - DNA, 25 bp, mus musculus
gcccgcttgactgtcaacgctgacg

SEQ ID NO: 126072 - DNA, 25 bp, mus musculus
ttgactgtcaacgctgacgtaggat

SEQ ID NO: 126073 - DNA, 25 bp, mus musculus
gctcttcatctgggtcctacgggag

SEQ ID NO: 126074 - DNA, 25 bp, mus musculus
agaagacagccagcaatggcaagtt

SEQ ID NO: 126075 - DNA, 25 bp, mus musculus
cagttctcgccaagaactgaggaca

SEQ ID NO: 126076 - DNA, 25 bp, mus musculus
cagccacctgagccatatgctgacc

SEQ ID NO: 126077 - DNA, 25 bp, mus musculus
cctgagccatatgctgacctctttg

SEQ ID NO: 126078 - DNA, 25 bp, mus musculus
ccatatgctgacctctttgccagga

SEQ ID NO: 126079 - DNA, 25 bp, mus musculus
gctgacctctttgccaggatcctcc

SEQ ID NO: 126080 - DNA, 25 bp, mus musculus
ggcccatgtccatccttggggaaag

SEQ ID NO: 126081 - DNA, 25 bp, mus musculus
ggccagaccaacattttgcttgtct

SEQ ID NO: 126082 - DNA, 25 bp, mus musculus
accaacattttgcttgtctgcttct

SEQ ID NO: 126083 - DNA, 25 bp, mus musculus
attttgcttgtctgcttctgcccaa

SEQ ID NO: 126084 - DNA, 25 bp, mus musculus
acctccatgtgtccctgctggacta

SEQ ID NO: 126085 - DNA, 25 bp, mus musculus
gcaagttgcggtcctacttgcccga

SEQ ID NO: 126086 - DNA, 25 bp, mus musculus
tgaaggaaacctgcacttggttcac

SEQ ID NO: 126087 - DNA, 25 bp, mus musculus
gcacttggttcaccgacaactatga

SEQ ID NO: 126088 - DNA, 25 bp, mus musculus
ggttcaccgacaactatgagcaggc

SEQ ID NO: 126089 - DNA, 25 bp, mus musculus
actatgagcaggcccggaagtaagg

SEQ ID NO: 126090 - DNA, 25 bp, mus musculus
ggcaagcaagtgctcgcctggcgat

SEQ ID NO: 126091 - DNA, 25 bp, mus musculus
caagtgctcgcctggcgatgcccag

SEQ ID NO: 126092 - DNA, 25 bp, mus musculus
ctcgcctggcgatgcccagtcagtg

SEQ ID NO: 126093 - DNA, 25 bp, mus musculus
gtgtgaacttactccatcgattcct

SEQ ID NO: 126094 - DNA, 25 bp, mus musculus
acttactccatcgattcctggcctt

SEQ ID NO: 126095 - DNA, 25 bp, mus musculus
tggtctctactggagaagagcatat

SEQ ID NO: 126096 - DNA, 25 bp, mus musculus
agcatatatacacatgccacgtaaa

SEQ ID NO: 126097 - DNA, 25 bp, mus musculus
tatacacatgccacgtaaatcatga

SEQ ID NO: 126098 - DNA, 25 bp, mus musculus
atcatgaggggctatctgagcccat

SEQ ID NO: 126099 - DNA, 25 bp, mus musculus
tatctgagcccatcaccatcagatg

SEQ ID NO: 126100 - DNA, 25 bp, mus musculus
agcccatcaccatcagatggacaaa

SEQ ID NO: 126101 - DNA, 25 bp, mus musculus
tcaccatcagatggacaaagcacga

SEQ ID NO: 126102 - DNA, 25 bp, mus musculus
tacttggagcactccttatgggagc

SEQ ID NO: 126103 - DNA, 25 bp, mus musculus
gagcactccttatgggagcagtgat

SEQ ID NO: 126104 - DNA, 25 bp, mus musculus
tgacttttcttatatggaagagaag

SEQ ID NO: 126105 - DNA, 25 bp, mus musculus
tccatcgattcctggcctttgggaa

SEQ ID NO: 126106 - DNA, 25 bp, mus musculus
atatgacccataagatcagaccaga

SEQ ID NO: 126107 - DNA, 25 bp, mus musculus
ataggaaaaccaccttgaggtgctg

SEQ ID NO: 126108 - DNA, 25 bp, mus musculus
ccttgaggtgctgggccttcaactt

SEQ ID NO: 126109 - DNA, 25 bp, mus musculus
ccctaacctggcagagggatggaag

SEQ ID NO: 126110 - DNA, 25 bp, mus musculus
atggaagcaaccagacccaggacat

SEQ ID NO: 126111 - DNA, 25 bp, mus musculus
gcaaccagacccaggacatggagat

SEQ ID NO: 126112 - DNA, 25 bp, mus musculus
ctgtggtggtctctactggagaaga

SEQ ID NO: 126113 - DNA, 25 bp, mus musculus
ctgaacaccagaaaatacacacggg

SEQ ID NO: 126114 - DNA, 25 bp, mus musculus
agaagtcatttcgccacaaatcaaa

SEQ ID NO: 126115 - DNA, 25 bp, mus musculus
tttacgaggtgcccaaatcctgaat

SEQ ID NO: 126116 - DNA, 25 bp, mus musculus
tgcccaaatcctgaattacacataa

SEQ ID NO: 126117 - DNA, 25 bp, mus musculus
ccaaatcctgaattacacataaagg

SEQ ID NO: 126118 - DNA, 25 bp, mus musculus
aatcctgaattacacataaaggtgt

SEQ ID NO: 126119 - DNA, 25 bp, mus musculus
cttgtcagcacggggactactactg

SEQ ID NO: 126120 - DNA, 25 bp, mus musculus
gtcagcacggggactactactgacg

SEQ ID NO: 126121 - DNA, 25 bp, mus musculus
agcacggggactactactgacgagt

SEQ ID NO: 126122 - DNA, 25 bp, mus musculus
gggactactactgacgagtttctgc

SEQ ID NO: 126123 - DNA, 25 bp, mus musculus
actactactgacgagtttctgccgg

SEQ ID NO: 126124 - DNA, 25 bp, mus musculus
actactgacgagtttctgccggagt

SEQ ID NO: 126125 - DNA, 25 bp, mus musculus
catttcgccacaaatcaaacttcct

SEQ ID NO: 126126 - DNA, 25 bp, mus musculus
ttcgccacaaatcaaacttcctctt

SEQ ID NO: 126127 - DNA, 25 bp, mus musculus
gccacaaatcaaacttcctcttaca

SEQ ID NO: 126128 - DNA, 25 bp, mus musculus
acttcctcttacatcagaaaactca

SEQ ID NO: 126129 - DNA, 25 bp, mus musculus
tcttacatcagaaaactcacaagaa

SEQ ID NO: 126130 - DNA, 25 bp, mus musculus
agtaaattccagcagggtaacagat

SEQ ID NO: 126131 - DNA, 25 bp, mus musculus
aaattccagcagggtaacagataat

SEQ ID NO: 126132 - DNA, 25 bp, mus musculus
taatttacgaggtgcccaaatcctg

SEQ ID NO: 126133 - DNA, 25 bp, mus musculus
atatcatcgacctctccatggaccc

SEQ ID NO: 126134 - DNA, 25 bp, mus musculus
ctgttgctgagctcaatgggaccca

SEQ ID NO: 126135 - DNA, 25 bp, mus musculus
gccctaagggttgccatcgagacaa

SEQ ID NO: 126136 - DNA, 25 bp, mus musculus
agggttgccatcgagacaagaggac

SEQ ID NO: 126137 - DNA, 25 bp, mus musculus
gctggattccttgtgcctcatatgc

SEQ ID NO: 126138 - DNA, 25 bp, mus musculus
ttccttgtgcctcatatgcccccaa

SEQ ID NO: 126139 - DNA, 25 bp, mus musculus
gtgcctcatatgcccccaagctggt

SEQ ID NO: 126140 - DNA, 25 bp, mus musculus
tctcagtaaaatcctggggtagaag

SEQ ID NO: 126141 - DNA, 25 bp, mus musculus
cgtcagcctctagtctttcagcact

SEQ ID NO: 126142 - DNA, 25 bp, mus musculus
gtctttcagcacttgggattggagt

SEQ ID NO: 126143 - DNA, 25 bp, mus musculus
cttcaaaagcggctgtcagtgttga

SEQ ID NO: 126144 - DNA, 25 bp, mus musculus
aagcggctgtcagtgttgatgttaa

SEQ ID NO: 126145 - DNA, 25 bp, mus musculus
ctgagctcaatgggacccaggtgga

SEQ ID NO: 126146 - DNA, 25 bp, mus musculus
aatctgtgcagcttaaagtcaacat

SEQ ID NO: 126147 - DNA, 25 bp, mus musculus
tcaacatagcccgaaaacagcccat

SEQ ID NO: 126148 - DNA, 25 bp, mus musculus
agcccatgctggacgctgctactgg

SEQ ID NO: 126149 - DNA, 25 bp, mus musculus
tgctggacgctgctactggcaaatc

SEQ ID NO: 126150 - DNA, 25 bp, mus musculus
acgctgctactggcaaatctgtctg

SEQ ID NO: 126151 - DNA, 25 bp, mus musculus
gcaaatctgtctggggctcccttgc

SEQ ID NO: 126152 - DNA, 25 bp, mus musculus
agaacagccctaagggttgccatcg

SEQ ID NO: 126153 - DNA, 25 bp, mus musculus
gatggggacaccagtgcctagcacc

SEQ ID NO: 126154 - DNA, 25 bp, mus musculus
tggggacaccagtgcctagcaccct

SEQ ID NO: 126155 - DNA, 25 bp, mus musculus
cgtggtacatcgctgtgggctacct

SEQ ID NO: 126156 - DNA, 25 bp, mus musculus
gtggtacatcgctgtgggctacctg

SEQ ID NO: 126157 - DNA, 25 bp, mus musculus
acctggatgacactcagttcgcgcg

SEQ ID NO: 126158 - DNA, 25 bp, mus musculus
cctggatgacactcagttcgcgcgc

SEQ ID NO: 126159 - DNA, 25 bp, mus musculus
acagcgcaggggagactgggacata

SEQ ID NO: 126160 - DNA, 25 bp, mus musculus
cagcgcaggggagactgggacatat

SEQ ID NO: 126161 - DNA, 25 bp, mus musculus
tgtatggctgtgaggtggagttctt

SEQ ID NO: 126162 - DNA, 25 bp, mus musculus
gtatggctgtgaggtggagttcttc

SEQ ID NO: 126163 - DNA, 25 bp, mus musculus
ttcttcgggagcctcttccgcgctt

SEQ ID NO: 126164 - DNA, 25 bp, mus musculus
tcttcgggagcctcttccgcgctta

SEQ ID NO: 126165 - DNA, 25 bp, mus musculus
tggctgcctcacaagtccagaccca

SEQ ID NO: 126166 - DNA, 25 bp, mus musculus
aagtccagacccagacctgcccagg

SEQ ID NO: 126167 - DNA, 25 bp, mus musculus
ctgcccaggctcacactcgctgagg

SEQ ID NO: 126168 - DNA, 25 bp, mus musculus
cccaggctcacactcgctgaggtac

SEQ ID NO: 126169 - DNA, 25 bp, mus musculus
gcgaaccgtggtacatcgctgtggg

SEQ ID NO: 126170 - DNA, 25 bp, mus musculus
cgaaccgtggtacatcgctgtgggc

SEQ ID NO: 126171 - DNA, 25 bp, mus musculus
aaccgtggtacatcgctgtgggcta

SEQ ID NO: 126172 - DNA, 25 bp, mus musculus
accgtggtacatcgctgtgggctac

SEQ ID NO: 126173 - DNA, 25 bp, mus musculus
ggcaagattacctcactctgaatga

SEQ ID NO: 126174 - DNA, 25 bp, mus musculus
tgagcacctggactgcagcagagtc

SEQ ID NO: 126175 - DNA, 25 bp, mus musculus
cttctgacatcatcatgatctggca

SEQ ID NO: 126176 - DNA, 25 bp, mus musculus
tcaccctgagatggagtagacctcc

SEQ ID NO: 126177 - DNA, 25 bp, mus musculus
ggagtagacctcctcagtctttcat

SEQ ID NO: 126178 - DNA, 25 bp, mus musculus
ctcagtctttcattttcatcataat

SEQ ID NO: 126179 - DNA, 25 bp, mus musculus
ctttcattttcatcataatagttgc

SEQ ID NO: 126180 - DNA, 25 bp, mus musculus
tagttgctgttggcctggttctcct

SEQ ID NO: 126181 - DNA, 25 bp, mus musculus
gcctggttctcctgggagcttcagt

SEQ ID NO: 126182 - DNA, 25 bp, mus musculus
ttctcctgggagcttcagtggctac

SEQ ID NO: 126183 - DNA, 25 bp, mus musculus
tggctactcttgtcatgtggaagaa

SEQ ID NO: 126184 - DNA, 25 bp, mus musculus
ctcttgtcatgtggaagaagagctc

SEQ ID NO: 126185 - DNA, 25 bp, mus musculus
cctggactgcagcagagtcggcagc

SEQ ID NO: 126186 - DNA, 25 bp, mus musculus
ctgcagcagagtcggcagctgagat

SEQ ID NO: 126187 - DNA, 25 bp, mus musculus
tggctgagttctggagggtctactt

SEQ ID NO: 126188 - DNA, 25 bp, mus musculus
tctacttggagggcccttgcatggt

SEQ ID NO: 126189 - DNA, 25 bp, mus musculus
gcccttgcatggtgtggctctttaa

SEQ ID NO: 126190 - DNA, 25 bp, mus musculus
atgagactctactgcgcacagagcc

SEQ ID NO: 126191 - DNA, 25 bp, mus musculus
tgcgcacagagcccccaaaggcata

SEQ ID NO: 126192 - DNA, 25 bp, mus musculus
tctacccttctgacatcatcatgat

SEQ ID NO: 126193 - DNA, 25 bp, mus musculus
taacatcagatctgggcaagtgtcc

SEQ ID NO: 126194 - DNA, 25 bp, mus musculus
cctttccttcatagctatccaatgc

SEQ ID NO: 126195 - DNA, 25 bp, mus musculus
ttgggtcagcctagagcccctgcac

SEQ ID NO: 126196 - DNA, 25 bp, mus musculus
cagcctagagcccctgcacacattg

SEQ ID NO: 126197 - DNA, 25 bp, mus musculus
agagcccctgcacacattgtgtctc

SEQ ID NO: 126198 - DNA, 25 bp, mus musculus
cctgcacacattgtgtctcagagat

SEQ ID NO: 126199 - DNA, 25 bp, mus musculus
cacattgtgtctcagagatggtgct

SEQ ID NO: 126200 - DNA, 25 bp, mus musculus
gagaccaccagagttggccttcaga

SEQ ID NO: 126201 - DNA, 25 bp, mus musculus
ttattaacttgatcccatcttcaga

SEQ ID NO: 126202 - DNA, 25 bp, mus musculus
acttgatcccatcttcagagcttat

SEQ ID NO: 126203 - DNA, 25 bp, mus musculus
tcccatcttcagagcttattctaag

SEQ ID NO: 126204 - DNA, 25 bp, mus musculus
cacaagtaaacacttcgctgctatc

SEQ ID NO: 126205 - DNA, 25 bp, mus musculus
cttcatagctatccaatgcacaaca

SEQ ID NO: 126206 - DNA, 25 bp, mus musculus
agctatccaatgcacaacagctgtc

SEQ ID NO: 126207 - DNA, 25 bp, mus musculus
cacaacagctgtctggcttccagag

SEQ ID NO: 126208 - DNA, 25 bp, mus musculus
ctggcttccagagccacacatttgg

SEQ ID NO: 126209 - DNA, 25 bp, mus musculus
tccagagccacacatttggcagcct

SEQ ID NO: 126210 - DNA, 25 bp, mus musculus
ggcctgtctgtttgctggtgagcta

SEQ ID NO: 126211 - DNA, 25 bp, mus musculus
agatagacctcaccaagctggagag

SEQ ID NO: 126212 - DNA, 25 bp, mus musculus
ctgcatttgggtcagcctagagccc

SEQ ID NO: 126213 - DNA, 25 bp, mus musculus
gatcccagaggctgaactaaaccgg

SEQ ID NO: 126214 - DNA, 25 bp, mus musculus
gtctacatccttaggcagcctgact

SEQ ID NO: 126215 - DNA, 25 bp, mus musculus
gtttgcttcctccctgggtatcaga

SEQ ID NO: 126216 - DNA, 25 bp, mus musculus
ttcctccctgggtatcagataaggt

SEQ ID NO: 126217 - DNA, 25 bp, mus musculus
ctccctgggtatcagataaggtgga

SEQ ID NO: 126218 - DNA, 25 bp, mus musculus
cccactctccaacagatgacttgaa

SEQ ID NO: 126219 - DNA, 25 bp, mus musculus
actctccaacagatgacttgaatga

SEQ ID NO: 126220 - DNA, 25 bp, mus musculus
acttgaatgacaaccctaatggcca

SEQ ID NO: 126221 - DNA, 25 bp, mus musculus
tgaatgacaaccctaatggccaggc

SEQ ID NO: 126222 - DNA, 25 bp, mus musculus
atgacaaccctaatggccaggccct

SEQ ID NO: 126223 - DNA, 25 bp, mus musculus
accctaatggccaggccctgcaggt

SEQ ID NO: 126224 - DNA, 25 bp, mus musculus
ctaatggccaggccctgcaggtccc

SEQ ID NO: 126225 - DNA, 25 bp, mus musculus
tacatccttaggcagcctgactgca

SEQ ID NO: 126226 - DNA, 25 bp, mus musculus
aggccctgcaggtccctagcactat

SEQ ID NO: 126227 - DNA, 25 bp, mus musculus
cttaggcagcctgactgcagctcgc

SEQ ID NO: 126228 - DNA, 25 bp, mus musculus
aggcagcctgactgcagctcgccgg

SEQ ID NO: 126229 - DNA, 25 bp, mus musculus
gtgaccaacacttaccagggacctg

SEQ ID NO: 126230 - DNA, 25 bp, mus musculus
taccagggacctgtgaatggtggct

SEQ ID NO: 126231 - DNA, 25 bp, mus musculus
ggtggctgccatccttaagtttgct

SEQ ID NO: 126232 - DNA, 25 bp, mus musculus
ggctgccatccttaagtttgcttcc

SEQ ID NO: 126233 - DNA, 25 bp, mus musculus
catccttaagtttgcttcctccctg

SEQ ID NO: 126234 - DNA, 25 bp, mus musculus
ctgcatccacgtcgacaacagccag

SEQ ID NO: 126235 - DNA, 25 bp, mus musculus
catccacgtcgacaacagccagtgc

SEQ ID NO: 126236 - DNA, 25 bp, mus musculus
agccagtgctgtccgcagtgcaagg

SEQ ID NO: 126237 - DNA, 25 bp, mus musculus
cagtgctgtccgcagtgcaaggaga

SEQ ID NO: 126238 - DNA, 25 bp, mus musculus
gtgctgtccgcagtgcaaggagaag

SEQ ID NO: 126239 - DNA, 25 bp, mus musculus
tactgcgagttccggggcaagacct

SEQ ID NO: 126240 - DNA, 25 bp, mus musculus
ggcaagacctaccagactttggagg

SEQ ID NO: 126241 - DNA, 25 bp, mus musculus
ctaccagactttggaggagtttgtg

SEQ ID NO: 126242 - DNA, 25 bp, mus musculus
atttctaggatctgtactaatcaga

SEQ ID NO: 126243 - DNA, 25 bp, mus musculus
atattattggctggtgctgaagaag

SEQ ID NO: 126244 - DNA, 25 bp, mus musculus
tattggctggtgctgaagaagaaag

SEQ ID NO: 126245 - DNA, 25 bp, mus musculus
atttgcactatggttcatggggttt

SEQ ID NO: 126246 - DNA, 25 bp, mus musculus
atccacgtcgacaacagccagtgct

SEQ ID NO: 126247 - DNA, 25 bp, mus musculus
ccacgtcgacaacagccagtgctgt

SEQ ID NO: 126248 - DNA, 25 bp, mus musculus
cacgtcgacaacagccagtgctgtc

SEQ ID NO: 126249 - DNA, 25 bp, mus musculus
gtcgacaacagccagtgctgtccgc

SEQ ID NO: 126250 - DNA, 25 bp, mus musculus
cgacaacagccagtgctgtccgcag

SEQ ID NO: 126251 - DNA, 25 bp, mus musculus
caacagccagtgctgtccgcagtgc

SEQ ID NO: 126252 - DNA, 25 bp, mus musculus
aacagccagtgctgtccgcagtgca

SEQ ID NO: 126253 - DNA, 25 bp, mus musculus
cagccagtgctgtccgcagtgcaag

SEQ ID NO: 126254 - DNA, 25 bp, mus musculus
ttccacgccaattcatcgttgacta

SEQ ID NO: 126255 - DNA, 25 bp, mus musculus
gccaattcatcgttgactattttga

SEQ ID NO: 126256 - DNA, 25 bp, mus musculus
cacctgcatagctccatctcctata

SEQ ID NO: 126257 - DNA, 25 bp, mus musculus
catagctccatctcctataagctgt

SEQ ID NO: 126258 - DNA, 25 bp, mus musculus
tcctataagctgtttgctgccaagt

SEQ ID NO: 126259 - DNA, 25 bp, mus musculus
aagctgtttgctgccaagtagccac

SEQ ID NO: 126260 - DNA, 25 bp, mus musculus
tttgctgccaagtagccacatcgag

SEQ ID NO: 126261 - DNA, 25 bp, mus musculus
tagccacatcgagggactcttcact

SEQ ID NO: 126262 - DNA, 25 bp, mus musculus
catcgagggactcttcacttgaaat

SEQ ID NO: 126263 - DNA, 25 bp, mus musculus
tcccagttgttcacactgtttggtg

SEQ ID NO: 126264 - DNA, 25 bp, mus musculus
acactgtttggtgacagctattcta

SEQ ID NO: 126265 - DNA, 25 bp, mus musculus
tttggtgacagctattctaggtaga

SEQ ID NO: 126266 - DNA, 25 bp, mus musculus
tcatcgttgactattttgaaaccag

SEQ ID NO: 126267 - DNA, 25 bp, mus musculus
attttgaaaccagcagcctttgctc

SEQ ID NO: 126268 - DNA, 25 bp, mus musculus
tttgctcccagccaggtgtcatttt

SEQ ID NO: 126269 - DNA, 25 bp, mus musculus
tctgcgctgactccaaagagacctg

SEQ ID NO: 126270 - DNA, 25 bp, mus musculus
acatcactgacctggaactgaatgc

SEQ ID NO: 126271 - DNA, 25 bp, mus musculus
tgaatgcctgagagtcttggaggca

SEQ ID NO: 126272 - DNA, 25 bp, mus musculus
ccctgtagagcaggggcttgagccg

SEQ ID NO: 126273 - DNA, 25 bp, mus musculus
tgagccgaacattcctgccacctgc

SEQ ID NO: 126274 - DNA, 25 bp, mus musculus
ccagtgtcaatttcccggacattcg

SEQ ID NO: 126275 - DNA, 25 bp, mus musculus
cagtgtcaatttcccggacattcgc

SEQ ID NO: 126276 - DNA, 25 bp, mus musculus
tcgcacagaagccaagttcaattgt

SEQ ID NO: 126277 - DNA, 25 bp, mus musculus
caagttcaattgtccctgggccgca

SEQ ID NO: 126278 - DNA, 25 bp, mus musculus
agttcaattgtccctgggccgcaat

SEQ ID NO: 126279 - DNA, 25 bp, mus musculus
gttcaattgtccctgggccgcaata

SEQ ID NO: 126280 - DNA, 25 bp, mus musculus
tcaattgtccctgggccgcaatatt

SEQ ID NO: 126281 - DNA, 25 bp, mus musculus
caattgtccctgggccgcaatattt

SEQ ID NO: 126282 - DNA, 25 bp, mus musculus
attgtccctgggccgcaatatttgt

SEQ ID NO: 126283 - DNA, 25 bp, mus musculus
ttgtccctgggccgcaatatttgtt

SEQ ID NO: 126284 - DNA, 25 bp, mus musculus
gtccctgggccgcaatatttgtttg

SEQ ID NO: 126285 - DNA, 25 bp, mus musculus
tccctgggccgcaatatttgtttgc

SEQ ID NO: 126286 - DNA, 25 bp, mus musculus
tcaatttcccggacattcgcacaga

SEQ ID NO: 126287 - DNA, 25 bp, mus musculus
caatttcccggacattcgcacagaa

SEQ ID NO: 126288 - DNA, 25 bp, mus musculus
cccggacattcgcacagaagccaag

SEQ ID NO: 126289 - DNA, 25 bp, mus musculus
cggacattcgcacagaagccaagtt

SEQ ID NO: 126290 - DNA, 25 bp, mus musculus
ggacattcgcacagaagccaagttc

SEQ ID NO: 126291 - DNA, 25 bp, mus musculus
acattcgcacagaagccaagttcaa

SEQ ID NO: 126292 - DNA, 25 bp, mus musculus
cattcgcacagaagccaagttcaat

SEQ ID NO: 126293 - DNA, 25 bp, mus musculus
ttcgcacagaagccaagttcaattg

SEQ ID NO: 126294 - DNA, 25 bp, mus musculus
agctggtccagtgcctcacagagtt

SEQ ID NO: 126295 - DNA, 25 bp, mus musculus
agtgcctcacagagttccacgctgc

SEQ ID NO: 126296 - DNA, 25 bp, mus musculus
atcacccagccttagcagtgcttcc

SEQ ID NO: 126297 - DNA, 25 bp, mus musculus
cagccttagcagtgcttccaaacct

SEQ ID NO: 126298 - DNA, 25 bp, mus musculus
ccttagcagtgcttccaaacctcag

SEQ ID NO: 126299 - DNA, 25 bp, mus musculus
tgcttccaaacctcagcttttaacg

SEQ ID NO: 126300 - DNA, 25 bp, mus musculus
caaacctcagcttttaacgatgacg

SEQ ID NO: 126301 - DNA, 25 bp, mus musculus
gctgtcttagtgccaactgcttcta

SEQ ID NO: 126302 - DNA, 25 bp, mus musculus
gtcttagtgccaactgcttctattc

SEQ ID NO: 126303 - DNA, 25 bp, mus musculus
gtgccaactgcttctattcttaatg

SEQ ID NO: 126304 - DNA, 25 bp, mus musculus
ttgtctggtttgccttatacgaaga

SEQ ID NO: 126305 - DNA, 25 bp, mus musculus
tctggtttgccttatacgaagaaag

SEQ ID NO: 126306 - DNA, 25 bp, mus musculus
tcacagagttccacgctgccctggg

SEQ ID NO: 126307 - DNA, 25 bp, mus musculus
agttccacgctgccctgggagccta

SEQ ID NO: 126308 - DNA, 25 bp, mus musculus
tgggagcctacgtctgacttctctc

SEQ ID NO: 126309 - DNA, 25 bp, mus musculus
gagcctacgtctgacttctctccca

SEQ ID NO: 126310 - DNA, 25 bp, mus musculus
agctccgccactcagaagaaagtgc

SEQ ID NO: 126311 - DNA, 25 bp, mus musculus
aaagtgcctgtctgtcacggatgcc

SEQ ID NO: 126312 - DNA, 25 bp, mus musculus
tgtcacggatgcccctcgtgcagcg

SEQ ID NO: 126313 - DNA, 25 bp, mus musculus
tgcagcgcagtgcctgcaggggcac

SEQ ID NO: 126314 - DNA, 25 bp, mus musculus
cccgagcaacaccatgaagctctgc

SEQ ID NO: 126315 - DNA, 25 bp, mus musculus
catgaagctctgcgtgtctgccctc

SEQ ID NO: 126316 - DNA, 25 bp, mus musculus
attcctgaccaaaagaggcagacag

SEQ ID NO: 126317 - DNA, 25 bp, mus musculus
tgagccctgggtcactgagtacatg

SEQ ID NO: 126318 - DNA, 25 bp, mus musculus
cctcagccctgatgcttctcactga

SEQ ID NO: 126319 - DNA, 25 bp, mus musculus
tgcttctcactgagaagcgtccttg

SEQ ID NO: 126320 - DNA, 25 bp, mus musculus
tcactgagaagcgtccttgctcctc

SEQ ID NO: 126321 - DNA, 25 bp, mus musculus
gctcctcacgttcagatttcctgcc

SEQ ID NO: 126322 - DNA, 25 bp, mus musculus
ggtccaccattgctgaaactctgct

SEQ ID NO: 126323 - DNA, 25 bp, mus musculus
ccattgctgaaactctgctattgtg

SEQ ID NO: 126324 - DNA, 25 bp, mus musculus
ctgaaactctgctattgtggatatg

SEQ ID NO: 126325 - DNA, 25 bp, mus musculus
ctctgctattgtggatatgactgtg

SEQ ID NO: 126326 - DNA, 25 bp, mus musculus
ggctgccttctgtgctccagggttc

SEQ ID NO: 126327 - DNA, 25 bp, mus musculus
ctcagcaccaatgggctctgaccct

SEQ ID NO: 126328 - DNA, 25 bp, mus musculus
ccggcagcttcacagaagctttgtg

SEQ ID NO: 126329 - DNA, 25 bp, mus musculus
gcttcacagaagctttgtgatggat

SEQ ID NO: 126330 - DNA, 25 bp, mus musculus
tgagaccagcagtctttgctccaag

SEQ ID NO: 126331 - DNA, 25 bp, mus musculus
cagcagtctttgctccaagccagct

SEQ ID NO: 126332 - DNA, 25 bp, mus musculus
tctttgctccaagccagctgtggta

SEQ ID NO: 126333 - DNA, 25 bp, mus musculus
tgtggtattcctgaccaaaagaggc

SEQ ID NO: 126334 - DNA, 25 bp, mus musculus
agtgccttttgtcttcctgtcagct

SEQ ID NO: 126335 - DNA, 25 bp, mus musculus
gtgccttttgtcttcctgtcagctc

SEQ ID NO: 126336 - DNA, 25 bp, mus musculus
cctgtcagctctgtcaatcacgcct

SEQ ID NO: 126337 - DNA, 25 bp, mus musculus
ctgtcagctctgtcaatcacgcctg

SEQ ID NO: 126338 - DNA, 25 bp, mus musculus
tgtcagctctgtcaatcacgcctgt

SEQ ID NO: 126339 - DNA, 25 bp, mus musculus
gtcagctctgtcaatcacgcctgtc

SEQ ID NO: 126340 - DNA, 25 bp, mus musculus
tcagctctgtcaatcacgcctgtcc

SEQ ID NO: 126341 - DNA, 25 bp, mus musculus
cagctctgtcaatcacgcctgtcct

SEQ ID NO: 126342 - DNA, 25 bp, mus musculus
agctctgtcaatcacgcctgtcctc

SEQ ID NO: 126343 - DNA, 25 bp, mus musculus
gctctgtcaatcacgcctgtcctct

SEQ ID NO: 126344 - DNA, 25 bp, mus musculus
tctgtcaatcacgcctgtcctctca

SEQ ID NO: 126345 - DNA, 25 bp, mus musculus
ccctgatacttgttattaagaaatg

SEQ ID NO: 126346 - DNA, 25 bp, mus musculus
tgccttttgtcttcctgtcagctct

SEQ ID NO: 126347 - DNA, 25 bp, mus musculus
gccttttgtcttcctgtcagctctg

SEQ ID NO: 126348 - DNA, 25 bp, mus musculus
ccttttgtcttcctgtcagctctgt

SEQ ID NO: 126349 - DNA, 25 bp, mus musculus
tttgtcttcctgtcagctctgtcaa

SEQ ID NO: 126350 - DNA, 25 bp, mus musculus
ttgtcttcctgtcagctctgtcaat

SEQ ID NO: 126351 - DNA, 25 bp, mus musculus
tgtcttcctgtcagctctgtcaatc

SEQ ID NO: 126352 - DNA, 25 bp, mus musculus
gtcttcctgtcagctctgtcaatca

SEQ ID NO: 126353 - DNA, 25 bp, mus musculus
cttcctgtcagctctgtcaatcacg

SEQ ID NO: 126354 - DNA, 25 bp, mus musculus
gtcggttccttctgcgtcgtctccg

SEQ ID NO: 126355 - DNA, 25 bp, mus musculus
ggttccttctgcgtcgtctccgagc

SEQ ID NO: 126356 - DNA, 25 bp, mus musculus
aacatcgctgtgggcaaatccacct

SEQ ID NO: 126357 - DNA, 25 bp, mus musculus
gtgggcaaatccacctttgtgaagt

SEQ ID NO: 126358 - DNA, 25 bp, mus musculus
tgggcaaatccacctttgtgaagtt

SEQ ID NO: 126359 - DNA, 25 bp, mus musculus
gcaaatccacctttgtgaagttact

SEQ ID NO: 126360 - DNA, 25 bp, mus musculus
aatccacctttgtgaagttactcat

SEQ ID NO: 126361 - DNA, 25 bp, mus musculus
tccacctttgtgaagttactcatga

SEQ ID NO: 126362 - DNA, 25 bp, mus musculus
cgacagaacctatagcagagtggca

SEQ ID NO: 126363 - DNA, 25 bp, mus musculus
acagaacctatagcagagtggcaga

SEQ ID NO: 126364 - DNA, 25 bp, mus musculus
aacctatagcagagtggcagaatat

SEQ ID NO: 126365 - DNA, 25 bp, mus musculus
tccaaacgtcttggaaacttgctag

SEQ ID NO: 126366 - DNA, 25 bp, mus musculus
ttccttctgcgtcgtctccgagcgt

SEQ ID NO: 126367 - DNA, 25 bp, mus musculus
ctgcggaacgcgctcgtggacgcgc

SEQ ID NO: 126368 - DNA, 25 bp, mus musculus
gtggacgcgccacacgccagggcca

SEQ ID NO: 126369 - DNA, 25 bp, mus musculus
tggacgcgccacacgccagggccat

SEQ ID NO: 126370 - DNA, 25 bp, mus musculus
cacacgccagggccatgcacgacgg

SEQ ID NO: 126371 - DNA, 25 bp, mus musculus
cgaaggctctgcattgaaggcaaca

SEQ ID NO: 126372 - DNA, 25 bp, mus musculus
gaaggcaacatcgctgtgggcaaat

SEQ ID NO: 126373 - DNA, 25 bp, mus musculus
gcaacatcgctgtgggcaaatccac

SEQ ID NO: 126374 - DNA, 25 bp, mus musculus
caagcctcgtgtacgtcgccctggc

SEQ ID NO: 126375 - DNA, 25 bp, mus musculus
gaaggctcatgctgaccaacctagt

SEQ ID NO: 126376 - DNA, 25 bp, mus musculus
gaccaacctagtacatgcagcgtgt

SEQ ID NO: 126377 - DNA, 25 bp, mus musculus
caacctagtacatgcagcgtgtggc

SEQ ID NO: 126378 - DNA, 25 bp, mus musculus
tgcagctggtggctattttgtgcct

SEQ ID NO: 126379 - DNA, 25 bp, mus musculus
tggtggctattttgtgcctgcagat

SEQ ID NO: 126380 - DNA, 25 bp, mus musculus
ggctattttgtgcctgcagattcgc

SEQ ID NO: 126381 - DNA, 25 bp, mus musculus
ctattttgtgcctgcagattcgcag

SEQ ID NO: 126382 - DNA, 25 bp, mus musculus
tattttgtgcctgcagattcgcagc

SEQ ID NO: 126383 - DNA, 25 bp, mus musculus
ttttgtgcctgcagattcgcagctc

SEQ ID NO: 126384 - DNA, 25 bp, mus musculus
tttgtgcctgcagattcgcagctca

SEQ ID NO: 126385 - DNA, 25 bp, mus musculus
tgtgcctgcagattcgcagctcagg

SEQ ID NO: 126386 - DNA, 25 bp, mus musculus
aaggctcatgctgaccaacctagta

SEQ ID NO: 126387 - DNA, 25 bp, mus musculus
gtgcctgcagattcgcagctcaggg

SEQ ID NO: 126388 - DNA, 25 bp, mus musculus
ggctcatgctgaccaacctagtaca

SEQ ID NO: 126389 - DNA, 25 bp, mus musculus
gctcatgctgaccaacctagtacat

SEQ ID NO: 126390 - DNA, 25 bp, mus musculus
tcatgctgaccaacctagtacatgc

SEQ ID NO: 126391 - DNA, 25 bp, mus musculus
catgctgaccaacctagtacatgca

SEQ ID NO: 126392 - DNA, 25 bp, mus musculus
tgctgaccaacctagtacatgcagc

SEQ ID NO: 126393 - DNA, 25 bp, mus musculus
gctgaccaacctagtacatgcagcg

SEQ ID NO: 126394 - DNA, 25 bp, mus musculus
tgaccaacctagtacatgcagcgtg

SEQ ID NO: 126395 - DNA, 25 bp, mus musculus
atagctacagttcctggagttacct

SEQ ID NO: 126396 - DNA, 25 bp, mus musculus
ctgtctatagacgtcactcgagatg

SEQ ID NO: 126397 - DNA, 25 bp, mus musculus
atcaacggtatcagctataaacgtc

SEQ ID NO: 126398 - DNA, 25 bp, mus musculus
gtatcagctataaacgtcagggagt

SEQ ID NO: 126399 - DNA, 25 bp, mus musculus
atcagctataaacgtcagggagtac

SEQ ID NO: 126400 - DNA, 25 bp, mus musculus
gagtactgtgcactcaccatgacta

SEQ ID NO: 126401 - DNA, 25 bp, mus musculus
gtactgtgcactcaccatgactata

SEQ ID NO: 126402 - DNA, 25 bp, mus musculus
tactgtgcactcaccatgactataa

SEQ ID NO: 126403 - DNA, 25 bp, mus musculus
ctgtgcactcaccatgactataacc

SEQ ID NO: 126404 - DNA, 25 bp, mus musculus
tgtgcactcaccatgactataaccg

SEQ ID NO: 126405 - DNA, 25 bp, mus musculus
tgcactcaccatgactataaccggt

SEQ ID NO: 126406 - DNA, 25 bp, mus musculus
gcactcaccatgactataaccggtc

SEQ ID NO: 126407 - DNA, 25 bp, mus musculus
tgtctatagacgtcactcgagatgt

SEQ ID NO: 126408 - DNA, 25 bp, mus musculus
cactcaccatgactataaccggtca

SEQ ID NO: 126409 - DNA, 25 bp, mus musculus
ctatagacgtcactcgagatgtacg

SEQ ID NO: 126410 - DNA, 25 bp, mus musculus
atagacgtcactcgagatgtacggc

SEQ ID NO: 126411 - DNA, 25 bp, mus musculus
acgtcactcgagatgtacggcattt

SEQ ID NO: 126412 - DNA, 25 bp, mus musculus
gtcactcgagatgtacggcatttgc

SEQ ID NO: 126413 - DNA, 25 bp, mus musculus
catttgctgaacctaggagacggca

SEQ ID NO: 126414 - DNA, 25 bp, mus musculus
atttgctgaacctaggagacggcat

SEQ ID NO: 126415 - DNA, 25 bp, mus musculus
gaaatcaacggtatcagctataaac

SEQ ID NO: 126416 - DNA, 25 bp, mus musculus
gtgtccatgaccactgtgggatacg

SEQ ID NO: 126417 - DNA, 25 bp, mus musculus
atgaccactgtgggatacggtgaca

SEQ ID NO: 126418 - DNA, 25 bp, mus musculus
actatcagcaagtctgagtacatgg

SEQ ID NO: 126419 - DNA, 25 bp, mus musculus
agcatagcccattacagacaggcta

SEQ ID NO: 126420 - DNA, 25 bp, mus musculus
gcccattacagacaggctaatatca

SEQ ID NO: 126421 - DNA, 25 bp, mus musculus
ggtaactgcaccacagctgatcaaa

SEQ ID NO: 126422 - DNA, 25 bp, mus musculus
tgcaccacagctgatcaaaactgcg

SEQ ID NO: 126423 - DNA, 25 bp, mus musculus
aagagcaagctcctgaccgatgttt

SEQ ID NO: 126424 - DNA, 25 bp, mus musculus
gcaacaggcaagccaacaaaagccc

SEQ ID NO: 126425 - DNA, 25 bp, mus musculus
tgtcccgctctgtagatactttact

SEQ ID NO: 126426 - DNA, 25 bp, mus musculus
ctttactaagcagtagtctttgaat

SEQ ID NO: 126427 - DNA, 25 bp, mus musculus
attttgctggcaatgcattgttgca

SEQ ID NO: 126428 - DNA, 25 bp, mus musculus
atcgctggtgtgctgacaattgccc

SEQ ID NO: 126429 - DNA, 25 bp, mus musculus
caggctcagttgctccatgttagtt

SEQ ID NO: 126430 - DNA, 25 bp, mus musculus
cagttgctccatgttagttctccta

SEQ ID NO: 126431 - DNA, 25 bp, mus musculus
gttagttctcctaacttagcctctg

SEQ ID NO: 126432 - DNA, 25 bp, mus musculus
aacttagcctctgacagtgacctca

SEQ ID NO: 126433 - DNA, 25 bp, mus musculus
gacagtgacctcagccgccgcagct

SEQ ID NO: 126434 - DNA, 25 bp, mus musculus
cgcagctcctctactatcagcaagt

SEQ ID NO: 126435 - DNA, 25 bp, mus musculus
tcctctactatcagcaagtctgagt

SEQ ID NO: 126436 - DNA, 25 bp, mus musculus
ttttactggtgatctttgagtctcg

SEQ ID NO: 126437 - DNA, 25 bp, mus musculus
ttactggtgatctttgagtctcgcc

SEQ ID NO: 126438 - DNA, 25 bp, mus musculus
ggcagccttggctattgccagtggc

SEQ ID NO: 126439 - DNA, 25 bp, mus musculus
gccttggctattgccagtggcaatg

SEQ ID NO: 126440 - DNA, 25 bp, mus musculus
cttggctattgccagtggcaatggc

SEQ ID NO: 126441 - DNA, 25 bp, mus musculus
tggctattgccagtggcaatggctt

SEQ ID NO: 126442 - DNA, 25 bp, mus musculus
caatggcttgttgctcaaaggtggg

SEQ ID NO: 126443 - DNA, 25 bp, mus musculus
atggcttgttgctcaaaggtgggaa

SEQ ID NO: 126444 - DNA, 25 bp, mus musculus
ccatccacggagtcaaggaggccat

SEQ ID NO: 126445 - DNA, 25 bp, mus musculus
atccacggagtcaaggaggccatac

SEQ ID NO: 126446 - DNA, 25 bp, mus musculus
aggatctctgccgccttgacaaaat

SEQ ID NO: 126447 - DNA, 25 bp, mus musculus
gatctctgccgccttgacaaaataa

SEQ ID NO: 126448 - DNA, 25 bp, mus musculus
gatctttgagtctcgccctgactgt

SEQ ID NO: 126449 - DNA, 25 bp, mus musculus
tttgagtctcgccctgactgtctac

SEQ ID NO: 126450 - DNA, 25 bp, mus musculus
cctgactgtctaccccaggtggcag

SEQ ID NO: 126451 - DNA, 25 bp, mus musculus
actgtctaccccaggtggcagcctt

SEQ ID NO: 126452 - DNA, 25 bp, mus musculus
tgtctaccccaggtggcagccttgg

SEQ ID NO: 126453 - DNA, 25 bp, mus musculus
taccccaggtggcagccttggctat

SEQ ID NO: 126454 - DNA, 25 bp, mus musculus
ccaggtggcagccttggctattgcc

SEQ ID NO: 126455 - DNA, 25 bp, mus musculus
aggtggcagccttggctattgccag

SEQ ID NO: 126456 - DNA, 25 bp, mus musculus
cacgtgagcactatccaattcttcc

SEQ ID NO: 126457 - DNA, 25 bp, mus musculus
cgtgagcactatccaattcttccag

SEQ ID NO: 126458 - DNA, 25 bp, mus musculus
ttttctctaccgtatggcgtgatca

SEQ ID NO: 126459 - DNA, 25 bp, mus musculus
tttctctaccgtatggcgtgatcac

SEQ ID NO: 126460 - DNA, 25 bp, mus musculus
tctctaccgtatggcgtgatcacca

SEQ ID NO: 126461 - DNA, 25 bp, mus musculus
ctctaccgtatggcgtgatcaccag

SEQ ID NO: 126462 - DNA, 25 bp, mus musculus
tctaccgtatggcgtgatcaccagc

SEQ ID NO: 126463 - DNA, 25 bp, mus musculus
taccgtatggcgtgatcaccagcgc

SEQ ID NO: 126464 - DNA, 25 bp, mus musculus
aaagtagccacagcaagggctttgg

SEQ ID NO: 126465 - DNA, 25 bp, mus musculus
aagtagccacagcaagggctttggc

SEQ ID NO: 126466 - DNA, 25 bp, mus musculus
caagggctttggctttgtgtgcttt

SEQ ID NO: 126467 - DNA, 25 bp, mus musculus
tggctttgtgtgcttttcctctcca

SEQ ID NO: 126468 - DNA, 25 bp, mus musculus
gtgagcactatccaattcttccagg

SEQ ID NO: 126469 - DNA, 25 bp, mus musculus
tgagcactatccaattcttccaggg

SEQ ID NO: 126470 - DNA, 25 bp, mus musculus
gcactatccaattcttccaggggtg

SEQ ID NO: 126471 - DNA, 25 bp, mus musculus
cactatccaattcttccaggggtgt

SEQ ID NO: 126472 - DNA, 25 bp, mus musculus
gacgactccatgtaatgaatgagag

SEQ ID NO: 126473 - DNA, 25 bp, mus musculus
acgactccatgtaatgaatgagagg

SEQ ID NO: 126474 - DNA, 25 bp, mus musculus
gaagttttctctaccgtatggcgtg

SEQ ID NO: 126475 - DNA, 25 bp, mus musculus
gttttctctaccgtatggcgtgatc

SEQ ID NO: 126476 - DNA, 25 bp, mus musculus
agtgacaagctgtccaaagatcccg

SEQ ID NO: 126477 - DNA, 25 bp, mus musculus
tagaagtgcctctaccataagtaag

SEQ ID NO: 126478 - DNA, 25 bp, mus musculus
cataatagcctgcattgtagtcagt

SEQ ID NO: 126479 - DNA, 25 bp, mus musculus
agcctgcattgtagtcagtgttcta

SEQ ID NO: 126480 - DNA, 25 bp, mus musculus
agtcagtgttctacagtgttctaca

SEQ ID NO: 126481 - DNA, 25 bp, mus musculus
tgttctacagtgttctacagcatct

SEQ ID NO: 126482 - DNA, 25 bp, mus musculus
acagtgttctacagcatctggttct

SEQ ID NO: 126483 - DNA, 25 bp, mus musculus
ttctacagcatctggttctgcatgg

SEQ ID NO: 126484 - DNA, 25 bp, mus musculus
agcatctggttctgcatggaaagca

SEQ ID NO: 126485 - DNA, 25 bp, mus musculus
tatttatcatggctttcatgaaatc

SEQ ID NO: 126486 - DNA, 25 bp, mus musculus
ctttcatgaaatcttcatcaccgac

SEQ ID NO: 126487 - DNA, 25 bp, mus musculus
tgaaatcttcatcaccgacttacag

SEQ ID NO: 126488 - DNA, 25 bp, mus musculus
tgcctctaccataagtaagtctgat

SEQ ID NO: 126489 - DNA, 25 bp, mus musculus
gagagtcacccatggagccagcatc

SEQ ID NO: 126490 - DNA, 25 bp, mus musculus
agccaactgtaccttggctaacaca

SEQ ID NO: 126491 - DNA, 25 bp, mus musculus
ctgtaccttggctaacacaaactat

SEQ ID NO: 126492 - DNA, 25 bp, mus musculus
cttggctaacacaaactatgtgaat

SEQ ID NO: 126493 - DNA, 25 bp, mus musculus
gaagcctactaatgtactcacagct

SEQ ID NO: 126494 - DNA, 25 bp, mus musculus
tactaatgtactcacagctcaacag

SEQ ID NO: 126495 - DNA, 25 bp, mus musculus
tgtactcacagctcaacaggactga

SEQ ID NO: 126496 - DNA, 25 bp, mus musculus
cacagctcaacaggactgatgcaga

SEQ ID NO: 126497 - DNA, 25 bp, mus musculus
ttgtgccatcgcaggtgtcttgacc

SEQ ID NO: 126498 - DNA, 25 bp, mus musculus
aggtgtcttgaccattgcattgcca

SEQ ID NO: 126499 - DNA, 25 bp, mus musculus
tggaacatgcccccttggtctgtgt

SEQ ID NO: 126500 - DNA, 25 bp, mus musculus
tatgcccttgatttatacatttcca

SEQ ID NO: 126501 - DNA, 25 bp, mus musculus
cttgatttatacatttccagaccac

SEQ ID NO: 126502 - DNA, 25 bp, mus musculus
atttccagaccactcatcaaggaaa

SEQ ID NO: 126503 - DNA, 25 bp, mus musculus
agaccactcatcaaggaaagtacaa

SEQ ID NO: 126504 - DNA, 25 bp, mus musculus
ttcattctccctattgcttcatact

SEQ ID NO: 126505 - DNA, 25 bp, mus musculus
ctccctattgcttcatactgaaaca

SEQ ID NO: 126506 - DNA, 25 bp, mus musculus
attgcttcatactgaaacaggtgcc

SEQ ID NO: 126507 - DNA, 25 bp, mus musculus
ctgtttttgcaagtgggctgcattc

SEQ ID NO: 126508 - DNA, 25 bp, mus musculus
tccctgtctcttaattttgtgacca

SEQ ID NO: 126509 - DNA, 25 bp, mus musculus
cttgaccattgcattgccagttcct

SEQ ID NO: 126510 - DNA, 25 bp, mus musculus
gcaagcccagtacatgcacgtgggc

SEQ ID NO: 126511 - DNA, 25 bp, mus musculus
catgcacgtgggcagttgccagcac

SEQ ID NO: 126512 - DNA, 25 bp, mus musculus
ctcttcagccgaggagctccgaaaa

SEQ ID NO: 126513 - DNA, 25 bp, mus musculus
gagtaactccactctgagtaagtcg

SEQ ID NO: 126514 - DNA, 25 bp, mus musculus
agccacttgcaccacgaacaataac

SEQ ID NO: 126515 - DNA, 25 bp, mus musculus
ctcctgtgtcaacatcaagaagata

SEQ ID NO: 126516 - DNA, 25 bp, mus musculus
acggttgccaattctgtgcccagta

SEQ ID NO: 126517 - DNA, 25 bp, mus musculus
tcttccaagtgtcactctgacaggt

SEQ ID NO: 126518 - DNA, 25 bp, mus musculus
tccaagtgtcactctgacaggttct

SEQ ID NO: 126519 - DNA, 25 bp, mus musculus
catccttttaatcaaaatggcacca

SEQ ID NO: 126520 - DNA, 25 bp, mus musculus
cgtgaagaagcccgctgctgcgcct

SEQ ID NO: 126521 - DNA, 25 bp, mus musculus
aatcgatctgtctgctattaagatc

SEQ ID NO: 126522 - DNA, 25 bp, mus musculus
atcgatctgtctgctattaagatcg

SEQ ID NO: 126523 - DNA, 25 bp, mus musculus
gatctgtctgctattaagatcgagt

SEQ ID NO: 126524 - DNA, 25 bp, mus musculus
tctgtctgctattaagatcgagttc

SEQ ID NO: 126525 - DNA, 25 bp, mus musculus
taagatcgagttctctaaggagcaa

SEQ ID NO: 126526 - DNA, 25 bp, mus musculus
gttctctaaggagcaacaggaggac

SEQ ID NO: 126527 - DNA, 25 bp, mus musculus
ttctctaaggagcaacaggaggact

SEQ ID NO: 126528 - DNA, 25 bp, mus musculus
ggaggcatttctcctgtttgacaga

SEQ ID NO: 126529 - DNA, 25 bp, mus musculus
caagtgtcactctgacaggttcttc

SEQ ID NO: 126530 - DNA, 25 bp, mus musculus
gaggcatttctcctgtttgacagaa

SEQ ID NO: 126531 - DNA, 25 bp, mus musculus
aagtgtcactctgacaggttcttct

SEQ ID NO: 126532 - DNA, 25 bp, mus musculus
gtgtcactctgacaggttcttctgg

SEQ ID NO: 126533 - DNA, 25 bp, mus musculus
ctctgacaggttcttctggaggaga

SEQ ID NO: 126534 - DNA, 25 bp, mus musculus
tctgacaggttcttctggaggagat

SEQ ID NO: 126535 - DNA, 25 bp, mus musculus
gacaggttcttctggaggagatcct

SEQ ID NO: 126536 - DNA, 25 bp, mus musculus
aggttcttctggaggagatccttct

SEQ ID NO: 126537 - DNA, 25 bp, mus musculus
ttcttctggaggagatccttctttt

SEQ ID NO: 126538 - DNA, 25 bp, mus musculus
tgtccacgggaggctctgtcgcaag

SEQ ID NO: 126539 - DNA, 25 bp, mus musculus
agtctgaagcatccggcttctgtta

SEQ ID NO: 126540 - DNA, 25 bp, mus musculus
acatcgtcttggccatcctggaact

SEQ ID NO: 126541 - DNA, 25 bp, mus musculus
tcttggccatcctggaactgctaaa

SEQ ID NO: 126542 - DNA, 25 bp, mus musculus
tggccatcctggaactgctaaagta

SEQ ID NO: 126543 - DNA, 25 bp, mus musculus
ccatcctggaactgctaaagtacca

SEQ ID NO: 126544 - DNA, 25 bp, mus musculus
tgctaaagtaccaccagagggtgct

SEQ ID NO: 126545 - DNA, 25 bp, mus musculus
taaagtaccaccagagggtgctcta

SEQ ID NO: 126546 - DNA, 25 bp, mus musculus
agtaccaccagagggtgctctatat

SEQ ID NO: 126547 - DNA, 25 bp, mus musculus
accaccagagggtgctctatattga

SEQ ID NO: 126548 - DNA, 25 bp, mus musculus
ttgatattcaccatggcgatggcgt

SEQ ID NO: 126549 - DNA, 25 bp, mus musculus
atattcaccatggcgatggcgtgga

SEQ ID NO: 126550 - DNA, 25 bp, mus musculus
ctgaagcatccggcttctgttacgt

SEQ ID NO: 126551 - DNA, 25 bp, mus musculus
ttcaccatggcgatggcgtggaaga

SEQ ID NO: 126552 - DNA, 25 bp, mus musculus
aagcatccggcttctgttacgtcaa

SEQ ID NO: 126553 - DNA, 25 bp, mus musculus
catccggcttctgttacgtcaatga

SEQ ID NO: 126554 - DNA, 25 bp, mus musculus
ccggcttctgttacgtcaatgacat

SEQ ID NO: 126555 - DNA, 25 bp, mus musculus
gcttctgttacgtcaatgacatcgt

SEQ ID NO: 126556 - DNA, 25 bp, mus musculus
gttacgtcaatgacatcgtcttggc

SEQ ID NO: 126557 - DNA, 25 bp, mus musculus
acgtcaatgacatcgtcttggccat

SEQ ID NO: 126558 - DNA, 25 bp, mus musculus
tcaatgacatcgtcttggccatcct

SEQ ID NO: 126559 - DNA, 25 bp, mus musculus
tggacacccttaatgtttctatggc

SEQ ID NO: 126560 - DNA, 25 bp, mus musculus
agttccagggcatgccccttgcacg

SEQ ID NO: 126561 - DNA, 25 bp, mus musculus
tggaagtcccgatagacaagctgag

SEQ ID NO: 126562 - DNA, 25 bp, mus musculus
aagtcccgatagacaagctgagatg

SEQ ID NO: 126563 - DNA, 25 bp, mus musculus
tccgtcctatgccgctacaattgct

SEQ ID NO: 126564 - DNA, 25 bp, mus musculus
ctatgccgctacaattgcttccaaa

SEQ ID NO: 126565 - DNA, 25 bp, mus musculus
cgctacaattgcttccaaactggcg

SEQ ID NO: 126566 - DNA, 25 bp, mus musculus
tacaattgcttccaaactggcgatt

SEQ ID NO: 126567 - DNA, 25 bp, mus musculus
ttccaaactggcgattcacaaccca

SEQ ID NO: 126568 - DNA, 25 bp, mus musculus
caaactggcgattcacaacccaaat

SEQ ID NO: 126569 - DNA, 25 bp, mus musculus
tcacaacccaaatttacctgccact

SEQ ID NO: 126570 - DNA, 25 bp, mus musculus
caacccaaatttacctgccactctg

SEQ ID NO: 126571 - DNA, 25 bp, mus musculus
tccagggcatgccccttgcacgtac

SEQ ID NO: 126572 - DNA, 25 bp, mus musculus
aaatttacctgccactctgccagtt

SEQ ID NO: 126573 - DNA, 25 bp, mus musculus
ttgcacgtacaccatgccaagtcag

SEQ ID NO: 126574 - DNA, 25 bp, mus musculus
gtacaccatgccaagtcagtttctt

SEQ ID NO: 126575 - DNA, 25 bp, mus musculus
catgccaagtcagtttcttccacag

SEQ ID NO: 126576 - DNA, 25 bp, mus musculus
tcagtttcttccacagcaggccacc

SEQ ID NO: 126577 - DNA, 25 bp, mus musculus
gtcaccaccaagctcagagcctgga

SEQ ID NO: 126578 - DNA, 25 bp, mus musculus
aagctcagagcctggaagtcccgat

SEQ ID NO: 126579 - DNA, 25 bp, mus musculus
agagcctggaagtcccgatagacaa

SEQ ID NO: 126580 - DNA, 25 bp, mus musculus
ggcagcctgcacccatcagctgagc

SEQ ID NO: 126581 - DNA, 25 bp, mus musculus
ctgcacccatcagctgagctctgga

SEQ ID NO: 126582 - DNA, 25 bp, mus musculus
cagcaggatcgcatgggctaccagc

SEQ ID NO: 126583 - DNA, 25 bp, mus musculus
cagctgcatggatctgaggttaatg

SEQ ID NO: 126584 - DNA, 25 bp, mus musculus
gttaatggctcgctcccagctgtat

SEQ ID NO: 126585 - DNA, 25 bp, mus musculus
ggctcgctcccagctgtatccagct

SEQ ID NO: 126586 - DNA, 25 bp, mus musculus
tcgctcccagctgtatccagctttt

SEQ ID NO: 126587 - DNA, 25 bp, mus musculus
ctcccagctgtatccagcttttcgg

SEQ ID NO: 126588 - DNA, 25 bp, mus musculus
gtatccagcttttcggctgcccctg

SEQ ID NO: 126589 - DNA, 25 bp, mus musculus
tccagcttttcggctgcccctggca

SEQ ID NO: 126590 - DNA, 25 bp, mus musculus
gctgcccctggcacttacagtggga

SEQ ID NO: 126591 - DNA, 25 bp, mus musculus
cctggcacttacagtgggacttccg

SEQ ID NO: 126592 - DNA, 25 bp, mus musculus
cacccatcagctgagctctggagta

SEQ ID NO: 126593 - DNA, 25 bp, mus musculus
ccatcagctgagctctggagtacgc

SEQ ID NO: 126594 - DNA, 25 bp, mus musculus
gagctctggagtacgcctagccagg

SEQ ID NO: 126595 - DNA, 25 bp, mus musculus
ctctggagtacgcctagccaggtgg

SEQ ID NO: 126596 - DNA, 25 bp, mus musculus
agtacgcctagccaggtgggctttg

SEQ ID NO: 126597 - DNA, 25 bp, mus musculus
gggcccatgctaggtgacggctctt

SEQ ID NO: 126598 - DNA, 25 bp, mus musculus
cccatgctaggtgacggctcttccc

SEQ ID NO: 126599 - DNA, 25 bp, mus musculus
cttgcaccgggcagcagctccgtgg

SEQ ID NO: 126600 - DNA, 25 bp, mus musculus
cacctccactggagagcctaaagca

SEQ ID NO: 126601 - DNA, 25 bp, mus musculus
ctccactggagagcctaaagcaaca

SEQ ID NO: 126602 - DNA, 25 bp, mus musculus
ttcattgtttgaccggactccaacg

SEQ ID NO: 126603 - DNA, 25 bp, mus musculus
tcattgtttgaccggactccaacgg

SEQ ID NO: 126604 - DNA, 25 bp, mus musculus
taggggtcccacctccactggagag

SEQ ID NO: 126605 - DNA, 25 bp, mus musculus
tcccacctccactggagagcctaaa

SEQ ID NO: 126606 - DNA, 25 bp, mus musculus
ttcattgtttgaccggactccaacg

SEQ ID NO: 126607 - DNA, 25 bp, mus musculus
tcattgtttgaccggactccaacgg

SEQ ID NO: 126608 - DNA, 25 bp, mus musculus
cccacctccactggagagcctaaag

SEQ ID NO: 126609 - DNA, 25 bp, mus musculus
ccacctccactggagagcctaaagc

SEQ ID NO: 126610 - DNA, 25 bp, mus musculus
cacctccactggagagcctaaagca

SEQ ID NO: 126611 - DNA, 25 bp, mus musculus
ctccactggagagcctaaagcaaca

SEQ ID NO: 126612 - DNA, 25 bp, mus musculus
gctccagctgcatccgcactccgga

SEQ ID NO: 126613 - DNA, 25 bp, mus musculus
ctccagctgcatccgcactccggag

SEQ ID NO: 126614 - DNA, 25 bp, mus musculus
tccagctgcatccgcactccggagc

SEQ ID NO: 126615 - DNA, 25 bp, mus musculus
atccgcactccggagcccctcaagg

SEQ ID NO: 126616 - DNA, 25 bp, mus musculus
taggggtcccacctccactggagag

SEQ ID NO: 126617 - DNA, 25 bp, mus musculus
tcccacctccactggagagcctaaa

SEQ ID NO: 126618 - DNA, 25 bp, mus musculus
ttcattgtttgaccggactccaacg

SEQ ID NO: 126619 - DNA, 25 bp, mus musculus
tcattgtttgaccggactccaacgg

SEQ ID NO: 126620 - DNA, 25 bp, mus musculus
cccacctccactggagagcctaaag

SEQ ID NO: 126621 - DNA, 25 bp, mus musculus
ccacctccactggagagcctaaagc

SEQ ID NO: 126622 - DNA, 25 bp, mus musculus
cacctccactggagagcctaaagca

SEQ ID NO: 126623 - DNA, 25 bp, mus musculus
ctccactggagagcctaaagcaaca

SEQ ID NO: 126624 - DNA, 25 bp, mus musculus
gctccagctgcatccgcactccgga

SEQ ID NO: 126625 - DNA, 25 bp, mus musculus
ctccagctgcatccgcactccggag

SEQ ID NO: 126626 - DNA, 25 bp, mus musculus
tccagctgcatccgcactccggagc

SEQ ID NO: 126627 - DNA, 25 bp, mus musculus
atccgcactccggagcccctcaagg

SEQ ID NO: 126628 - DNA, 25 bp, mus musculus
tggccatgataaccgtgtcgagctg

SEQ ID NO: 126629 - DNA, 25 bp, mus musculus
gccatgataaccgtgtcgagctgcc

SEQ ID NO: 126630 - DNA, 25 bp, mus musculus
ccgtgtcgagctgccttggggtcac

SEQ ID NO: 126631 - DNA, 25 bp, mus musculus
cgtgtcgagctgccttggggtcaca

SEQ ID NO: 126632 - DNA, 25 bp, mus musculus
gtgtcgagctgccttggggtcacag

SEQ ID NO: 126633 - DNA, 25 bp, mus musculus
tgtcgagctgccttggggtcacaga

SEQ ID NO: 126634 - DNA, 25 bp, mus musculus
gcatgcccacactacaggcccggag

SEQ ID NO: 126635 - DNA, 25 bp, mus musculus
atgcccacactacaggcccggagct

SEQ ID NO: 126636 - DNA, 25 bp, mus musculus
tgcccacactacaggcccggagctt

SEQ ID NO: 126637 - DNA, 25 bp, mus musculus
cacactacaggcccggagctttggg

SEQ ID NO: 126638 - DNA, 25 bp, mus musculus
ctacaggcccggagctttggggctg

SEQ ID NO: 126639 - DNA, 25 bp, mus musculus
ccatgataaccgtgtcgagctgcct

SEQ ID NO: 126640 - DNA, 25 bp, mus musculus
catgataaccgtgtcgagctgcctt

SEQ ID NO: 126641 - DNA, 25 bp, mus musculus
atgataaccgtgtcgagctgccttg

SEQ ID NO: 126642 - DNA, 25 bp, mus musculus
tgataaccgtgtcgagctgccttgg

SEQ ID NO: 126643 - DNA, 25 bp, mus musculus
gataaccgtgtcgagctgccttggg

SEQ ID NO: 126644 - DNA, 25 bp, mus musculus
ataaccgtgtcgagctgccttgggg

SEQ ID NO: 126645 - DNA, 25 bp, mus musculus
taaccgtgtcgagctgccttggggt

SEQ ID NO: 126646 - DNA, 25 bp, mus musculus
accgtgtcgagctgccttggggtca

SEQ ID NO: 126647 - DNA, 25 bp, mus musculus
tgtctactaggtgtccctctgaggc

SEQ ID NO: 126648 - DNA, 25 bp, mus musculus
agttccgtcttgagtccctagccat

SEQ ID NO: 126649 - DNA, 25 bp, mus musculus
ctcatttgagcctcttggcccttgg

SEQ ID NO: 126650 - DNA, 25 bp, mus musculus
tcttggcccttgggtgctcatggcc

SEQ ID NO: 126651 - DNA, 25 bp, mus musculus
cccttgggtgctcatggccattcct

SEQ ID NO: 126652 - DNA, 25 bp, mus musculus
catggccattcctgcacacacacat

SEQ ID NO: 126653 - DNA, 25 bp, mus musculus
cattcctgcacacacacatatgctt

SEQ ID NO: 126654 - DNA, 25 bp, mus musculus
tgcacacacacatatgcttatatct

SEQ ID NO: 126655 - DNA, 25 bp, mus musculus
cacacatatgcttatatctggaact

SEQ ID NO: 126656 - DNA, 25 bp, mus musculus
tatatctggaactttctgctgaagg

SEQ ID NO: 126657 - DNA, 25 bp, mus musculus
tggaactttctgctgaagggagctg

SEQ ID NO: 126658 - DNA, 25 bp, mus musculus
tttctgctgaagggagctgttggtt

SEQ ID NO: 126659 - DNA, 25 bp, mus musculus
tccctctcttctgtggctcattaaa

SEQ ID NO: 126660 - DNA, 25 bp, mus musculus
tcgaggccagtctgggatatgtgag

SEQ ID NO: 126661 - DNA, 25 bp, mus musculus
atgtgaggcaccatcccaagaccat

SEQ ID NO: 126662 - DNA, 25 bp, mus musculus
ataagttcatgcagcggcacatttg

SEQ ID NO: 126663 - DNA, 25 bp, mus musculus
acatttgcctgctacagtacacaac

SEQ ID NO: 126664 - DNA, 25 bp, mus musculus
tacagtacacaacatcacatctggc

SEQ ID NO: 126665 - DNA, 25 bp, mus musculus
acacaacatcacatctggctgctcc

SEQ ID NO: 126666 - DNA, 25 bp, mus musculus
tccagtcactttgctttgggtattc

SEQ ID NO: 126667 - DNA, 25 bp, mus musculus
gggcttctgctgcatctaacattgg

SEQ ID NO: 126668 - DNA, 25 bp, mus musculus
cttctgctgcatctaacattggcgg

SEQ ID NO: 126669 - DNA, 25 bp, mus musculus
accacgcagggcctcaagctggtga

SEQ ID NO: 126670 - DNA, 25 bp, mus musculus
acgcagggcctcaagctggtgaccg

SEQ ID NO: 126671 - DNA, 25 bp, mus musculus
cagggcctcaagctggtgaccgcgc

SEQ ID NO: 126672 - DNA, 25 bp, mus musculus
ctcgggccacagagcggactgctgc

SEQ ID NO: 126673 - DNA, 25 bp, mus musculus
ccacagagcggactgctgcgtttcc

SEQ ID NO: 126674 - DNA, 25 bp, mus musculus
ctgctgcgtttccccgaaagatcaa

SEQ ID NO: 126675 - DNA, 25 bp, mus musculus
gaaatcggcaagcttctgaattcct

SEQ ID NO: 126676 - DNA, 25 bp, mus musculus
ggcaagcttctgaattcctacttgg

SEQ ID NO: 126677 - DNA, 25 bp, mus musculus
gaggatcactccgtgcacctgctct

SEQ ID NO: 126678 - DNA, 25 bp, mus musculus
ggatcactccgtgcacctgctcttc

SEQ ID NO: 126679 - DNA, 25 bp, mus musculus
ctgctgcatctaacattggcgggaa

SEQ ID NO: 126680 - DNA, 25 bp, mus musculus
gatcactccgtgcacctgctcttct

SEQ ID NO: 126681 - DNA, 25 bp, mus musculus
ctgcatctaacattggcgggaacct

SEQ ID NO: 126682 - DNA, 25 bp, mus musculus
catctaacattggcgggaacctggc

SEQ ID NO: 126683 - DNA, 25 bp, mus musculus
ctaacattggcgggaacctggcaag

SEQ ID NO: 126684 - DNA, 25 bp, mus musculus
acattggcgggaacctggcaagttg

SEQ ID NO: 126685 - DNA, 25 bp, mus musculus
acctggcaagttgaccggtgctgtg

SEQ ID NO: 126686 - DNA, 25 bp, mus musculus
cgtgctggcaagaccacgcagggcc

SEQ ID NO: 126687 - DNA, 25 bp, mus musculus
aagaccacgcagggcctcaagctgg

SEQ ID NO: 126688 - DNA, 25 bp, mus musculus
actgtgctggagccactaactagaa

SEQ ID NO: 126689 - DNA, 25 bp, mus musculus
ctggagccactaactagaaaagcct

SEQ ID NO: 126690 - DNA, 25 bp, mus musculus
cctagctctctagaatagagcattt

SEQ ID NO: 126691 - DNA, 25 bp, mus musculus
ctcagagacacgcattccttttggt

SEQ ID NO: 126692 - DNA, 25 bp, mus musculus
cccatatacacttactgttgtcctc

SEQ ID NO: 126693 - DNA, 25 bp, mus musculus
tacacttactgttgtcctctgggac

SEQ ID NO: 126694 - DNA, 25 bp, mus musculus
tactgttgtcctctgggactcatgt

SEQ ID NO: 126695 - DNA, 25 bp, mus musculus
tgtcctctgggactcatgtgtgaag

SEQ ID NO: 126696 - DNA, 25 bp, mus musculus
cagtcctgtgatttgcaaagattgg

SEQ ID NO: 126697 - DNA, 25 bp, mus musculus
tagcctcttaattaagtctatccct

SEQ ID NO: 126698 - DNA, 25 bp, mus musculus
tctacctcccatattggacctatta

SEQ ID NO: 126699 - DNA, 25 bp, mus musculus
cctattacaaatctagtcccagtgg

SEQ ID NO: 126700 - DNA, 25 bp, mus musculus
ttggagccatgccaaacgttcagta

SEQ ID NO: 126701 - DNA, 25 bp, mus musculus
ccatgccaaacgttcagtatagcca

SEQ ID NO: 126702 - DNA, 25 bp, mus musculus
caaacgttcagtatagccatgggac

SEQ ID NO: 126703 - DNA, 25 bp, mus musculus
ggcaaacaaatggcccactgtggtg

SEQ ID NO: 126704 - DNA, 25 bp, mus musculus
gccaatggaatctccttttccttct

SEQ ID NO: 126705 - DNA, 25 bp, mus musculus
tccttttccttctttgtcacactca

SEQ ID NO: 126706 - DNA, 25 bp, mus musculus
tccttctttgtcacactcattcaac

SEQ ID NO: 126707 - DNA, 25 bp, mus musculus
attcaacctagctctctagaataga

SEQ ID NO: 126708 - DNA, 25 bp, mus musculus
ggccagagtcccatggatctaactg

SEQ ID NO: 126709 - DNA, 25 bp, mus musculus
atggatctaactgtctccacttccc

SEQ ID NO: 126710 - DNA, 25 bp, mus musculus
ctggtttctcatatgggtagagtgt

SEQ ID NO: 126711 - DNA, 25 bp, mus musculus
tctaatgcaattctgccagtgttgt

SEQ ID NO: 126712 - DNA, 25 bp, mus musculus
ttttttaactgcaagaactctgtat

SEQ ID NO: 126713 - DNA, 25 bp, mus musculus
tctgtatttttccaagcacagcatg

SEQ ID NO: 126714 - DNA, 25 bp, mus musculus
caagcacagcatggttcccttcatt

SEQ ID NO: 126715 - DNA, 25 bp, mus musculus
ggttcccttcattcatattctctga

SEQ ID NO: 126716 - DNA, 25 bp, mus musculus
tcatattctctgagaaattggaatt

SEQ ID NO: 126717 - DNA, 25 bp, mus musculus
tggaattcatgtttcctctgaaatt

SEQ ID NO: 126718 - DNA, 25 bp, mus musculus
tcatgtttcctctgaaattatgtgc

SEQ ID NO: 126719 - DNA, 25 bp, mus musculus
tattccatttaagtcctaaatagct

SEQ ID NO: 126720 - DNA, 25 bp, mus musculus
gctagggttgcggatgtgtgccacc

SEQ ID NO: 126721 - DNA, 25 bp, mus musculus
tcctaaatagctctctttaaactgt

SEQ ID NO: 126722 - DNA, 25 bp, mus musculus
gatgtgtgccaccacatccaacctt

SEQ ID NO: 126723 - DNA, 25 bp, mus musculus
tggattctgtctcaagctttctaga

SEQ ID NO: 126724 - DNA, 25 bp, mus musculus
gctttgctgcctaagctatgtccca

SEQ ID NO: 126725 - DNA, 25 bp, mus musculus
aagctatgtcccagggctccagttt

SEQ ID NO: 126726 - DNA, 25 bp, mus musculus
tgtcccagggctccagtttaatact

SEQ ID NO: 126727 - DNA, 25 bp, mus musculus
gagtactcagcacattttatgttat

SEQ ID NO: 126728 - DNA, 25 bp, mus musculus
gttactctggtttctcatatgggta

SEQ ID NO: 126729 - DNA, 25 bp, mus musculus
tcaggccaggacgaccgagggcttt

SEQ ID NO: 126730 - DNA, 25 bp, mus musculus
tgggccagagcgtgagggtatcatc

SEQ ID NO: 126731 - DNA, 25 bp, mus musculus
tctaaccctggggacccagcgcctg

SEQ ID NO: 126732 - DNA, 25 bp, mus musculus
gacccagcgcctggaagcaggaggc

SEQ ID NO: 126733 - DNA, 25 bp, mus musculus
cacccggcatgtgacccaggaattc

SEQ ID NO: 126734 - DNA, 25 bp, mus musculus
gcatgtgacccaggaattcgtgacc

SEQ ID NO: 126735 - DNA, 25 bp, mus musculus
cttaacggccagtggctctctcagc

SEQ ID NO: 126736 - DNA, 25 bp, mus musculus
tctcagcactcatatggaccaacag

SEQ ID NO: 126737 - DNA, 25 bp, mus musculus
cactcatatggaccaacagttcttc

SEQ ID NO: 126738 - DNA, 25 bp, mus musculus
ctgctgctctacccacgagcttgct

SEQ ID NO: 126739 - DNA, 25 bp, mus musculus
ccacgagcttgctgaccacagagcc

SEQ ID NO: 126740 - DNA, 25 bp, mus musculus
tgctgtccaggaaccataaagtggg

SEQ ID NO: 126741 - DNA, 25 bp, mus musculus
caccatcgagtctcaggttggaggc

SEQ ID NO: 126742 - DNA, 25 bp, mus musculus
cagcaattctgggctcttccagaac

SEQ ID NO: 126743 - DNA, 25 bp, mus musculus
gctcttccagaacccagtgcaaagc

SEQ ID NO: 126744 - DNA, 25 bp, mus musculus
ccagaacccagtgcaaagcgagttc

SEQ ID NO: 126745 - DNA, 25 bp, mus musculus
cgagttcagcagcgtgaccagcacg

SEQ ID NO: 126746 - DNA, 25 bp, mus musculus
cagcacgcacagcaccacgactgag

SEQ ID NO: 126747 - DNA, 25 bp, mus musculus
gactgagcccttcctcatggatggt

SEQ ID NO: 126748 - DNA, 25 bp, mus musculus
gcccttcctcatggatggtctaacc

SEQ ID NO: 126749 - DNA, 25 bp, mus musculus
tgtgccactaggagggtcctttgtc

SEQ ID NO: 126750 - DNA, 25 bp, mus musculus
agggtcctttgtcacattcagtgct

SEQ ID NO: 126751 - DNA, 25 bp, mus musculus
ttgggcactcttccttttatccttg

SEQ ID NO: 126752 - DNA, 25 bp, mus musculus
ttttcctatcttacaagatccatgg

SEQ ID NO: 126753 - DNA, 25 bp, mus musculus
tatcttacaagatccatgggatctg

SEQ ID NO: 126754 - DNA, 25 bp, mus musculus
gaattcatggatcccatacaatgcc

SEQ ID NO: 126755 - DNA, 25 bp, mus musculus
atggatcccatacaatgccgcccaa

SEQ ID NO: 126756 - DNA, 25 bp, mus musculus
cgcccaacacttgagcttggaccct

SEQ ID NO: 126757 - DNA, 25 bp, mus musculus
acacttgagcttggacccttgtgaa

SEQ ID NO: 126758 - DNA, 25 bp, mus musculus
gagcttggacccttgtgaacttttg

SEQ ID NO: 126759 - DNA, 25 bp, mus musculus
gtaactagcattcttagggcttggg

SEQ ID NO: 126760 - DNA, 25 bp, mus musculus
gcttggggtccaaggccatgtattg

SEQ ID NO: 126761 - DNA, 25 bp, mus musculus
ctttgtcacattcagtgcttgtgga

SEQ ID NO: 126762 - DNA, 25 bp, mus musculus
cacattcagtgcttgtggacaagcg

SEQ ID NO: 126763 - DNA, 25 bp, mus musculus
tcacccttgctgtggcattgtggag

SEQ ID NO: 126764 - DNA, 25 bp, mus musculus
cggatctcagccctacgatacagct

SEQ ID NO: 126765 - DNA, 25 bp, mus musculus
tcagccctacgatacagcttcagtt

SEQ ID NO: 126766 - DNA, 25 bp, mus musculus
ctacgatacagcttcagttgcatga

SEQ ID NO: 126767 - DNA, 25 bp, mus musculus
tacagcttcagttgcatgagttggg

SEQ ID NO: 126768 - DNA, 25 bp, mus musculus
gtccgacttcatgaggagaacaacc

SEQ ID NO: 126769 - DNA, 25 bp, mus musculus
gcaagttcaagttccctggcgcaga

SEQ ID NO: 126770 - DNA, 25 bp, mus musculus
caagttcaagttccctggcgcagaa

SEQ ID NO: 126771 - DNA, 25 bp, mus musculus
tgttgctgaaacggctcattctgat

SEQ ID NO: 126772 - DNA, 25 bp, mus musculus
tgctgaaacggctcattctgatggc

SEQ ID NO: 126773 - DNA, 25 bp, mus musculus
gctgaaacggctcattctgatggct

SEQ ID NO: 126774 - DNA, 25 bp, mus musculus
tgaaacggctcattctgatggctgt

SEQ ID NO: 126775 - DNA, 25 bp, mus musculus
gaaacggctcattctgatggctgtg

SEQ ID NO: 126776 - DNA, 25 bp, mus musculus
aacggctcattctgatggctgtgtg

SEQ ID NO: 126777 - DNA, 25 bp, mus musculus
acggctcattctgatggctgtgtgt

SEQ ID NO: 126778 - DNA, 25 bp, mus musculus
ggctcattctgatggctgtgtgtaa

SEQ ID NO: 126779 - DNA, 25 bp, mus musculus
gctcattctgatggctgtgtgtaat

SEQ ID NO: 126780 - DNA, 25 bp, mus musculus
cattctgatggctgtgtgtaatata

SEQ ID NO: 126781 - DNA, 25 bp, mus musculus
agttcaagttccctggcgcagaaga

SEQ ID NO: 126782 - DNA, 25 bp, mus musculus
attctgatggctgtgtgtaatatat

SEQ ID NO: 126783 - DNA, 25 bp, mus musculus
gttcaagttccctggcgcagaagat

SEQ ID NO: 126784 - DNA, 25 bp, mus musculus
cagaagatcacatctcaaagaagtg

SEQ ID NO: 126785 - DNA, 25 bp, mus musculus
agaagatcacatctcaaagaagtgg

SEQ ID NO: 126786 - DNA, 25 bp, mus musculus
aagatcacatctcaaagaagtgggg

SEQ ID NO: 126787 - DNA, 25 bp, mus musculus
agatcacatctcaaagaagtggggc

SEQ ID NO: 126788 - DNA, 25 bp, mus musculus
atcacatctcaaagaagtggggctc

SEQ ID NO: 126789 - DNA, 25 bp, mus musculus
tcacatctcaaagaagtggggctca

SEQ ID NO: 126790 - DNA, 25 bp, mus musculus
ctgaatggcaatctcctggtaccca

SEQ ID NO: 126791 - DNA, 25 bp, mus musculus
gtacccaaaaactccagcagcagca

SEQ ID NO: 126792 - DNA, 25 bp, mus musculus
aagctcagcatcccttatgaaagtt

SEQ ID NO: 126793 - DNA, 25 bp, mus musculus
agcatcccttatgaaagtttctatg

SEQ ID NO: 126794 - DNA, 25 bp, mus musculus
aagctcaacaagccctccaagcttg

SEQ ID NO: 126795 - DNA, 25 bp, mus musculus
ccctccaagcttgaaggctctgaag

SEQ ID NO: 126796 - DNA, 25 bp, mus musculus
aggctgctgcaagctctcatggaca

SEQ ID NO: 126797 - DNA, 25 bp, mus musculus
ctgcaagctctcatggacatcctaa

SEQ ID NO: 126798 - DNA, 25 bp, mus musculus
gctctcatggacatcctaaatgagg

SEQ ID NO: 126799 - DNA, 25 bp, mus musculus
aagtgtgttgcctgagttgggaatc

SEQ ID NO: 126800 - DNA, 25 bp, mus musculus
tccttaaatgttcctgggtctggag

SEQ ID NO: 126801 - DNA, 25 bp, mus musculus
aatgttcctgggtctggagttgttg

SEQ ID NO: 126802 - DNA, 25 bp, mus musculus
caaggaactccttcaaaggccatgc

SEQ ID NO: 126803 - DNA, 25 bp, mus musculus
actccttcaaaggccatgctgcgac

SEQ ID NO: 126804 - DNA, 25 bp, mus musculus
tcaaaggccatgctgcgactcctac

SEQ ID NO: 126805 - DNA, 25 bp, mus musculus
gccatgctgcgactcctacaaagtg

SEQ ID NO: 126806 - DNA, 25 bp, mus musculus
aatgcactttcaaaacaatcaccaa

SEQ ID NO: 126807 - DNA, 25 bp, mus musculus
tcaccaaagaagtctccaagtgcaa

SEQ ID NO: 126808 - DNA, 25 bp, mus musculus
tctccaagtgcaaagctcagcatcc

SEQ ID NO: 126809 - DNA, 25 bp, mus musculus
agtgcaaagctcagcatcccttatg

SEQ ID NO: 126810 - DNA, 25 bp, mus musculus
acctactcctatagtcgcacctctg

SEQ ID NO: 126811 - DNA, 25 bp, mus musculus
ctactcctatagtcgcacctctgtg

SEQ ID NO: 126812 - DNA, 25 bp, mus musculus
caatctgtgcgattgcctgcattcc

SEQ ID NO: 126813 - DNA, 25 bp, mus musculus
atctgtgcgattgcctgcattccat

SEQ ID NO: 126814 - DNA, 25 bp, mus musculus
ctgtgcgattgcctgcattccatgt

SEQ ID NO: 126815 - DNA, 25 bp, mus musculus
gcgattgcctgcattccatgtgccg

SEQ ID NO: 126816 - DNA, 25 bp, mus musculus
gattgcctgcattccatgtgccgac

SEQ ID NO: 126817 - DNA, 25 bp, mus musculus
ttgcctgcattccatgtgccgacag

SEQ ID NO: 126818 - DNA, 25 bp, mus musculus
gcctgcattccatgtgccgacagac

SEQ ID NO: 126819 - DNA, 25 bp, mus musculus
gtccgttcgttcccaatggctatgc

SEQ ID NO: 126820 - DNA, 25 bp, mus musculus
ccgttcgttcccaatggctatgctt

SEQ ID NO: 126821 - DNA, 25 bp, mus musculus
gttcgttcccaatggctatgcttca

SEQ ID NO: 126822 - DNA, 25 bp, mus musculus
actcctatagtcgcacctctgtgtc

SEQ ID NO: 126823 - DNA, 25 bp, mus musculus
cgttcccaatggctatgcttcacca

SEQ ID NO: 126824 - DNA, 25 bp, mus musculus
ctatagtcgcacctctgtgtcagat

SEQ ID NO: 126825 - DNA, 25 bp, mus musculus
atagtcgcacctctgtgtcagatga

SEQ ID NO: 126826 - DNA, 25 bp, mus musculus
agtcgcacctctgtgtcagatgact

SEQ ID NO: 126827 - DNA, 25 bp, mus musculus
tcgcacctctgtgtcagatgacttt

SEQ ID NO: 126828 - DNA, 25 bp, mus musculus
acgcatccatcaatctgtgcgattg

SEQ ID NO: 126829 - DNA, 25 bp, mus musculus
atccatcaatctgtgcgattgcctg

SEQ ID NO: 126830 - DNA, 25 bp, mus musculus
atcaatctgtgcgattgcctgcatt

SEQ ID NO: 126831 - DNA, 25 bp, mus musculus
acaatcaaagcttgcccgaggaaca

SEQ ID NO: 126832 - DNA, 25 bp, mus musculus
atcaaagcttgcccgaggaacacaa

SEQ ID NO: 126833 - DNA, 25 bp, mus musculus
cacgttaactgttgcacttttgaat

SEQ ID NO: 126834 - DNA, 25 bp, mus musculus
aactgttgcacttttgaatgtccaa

SEQ ID NO: 126835 - DNA, 25 bp, mus musculus
tgcacttttgaatgtccaaaattta

SEQ ID NO: 126836 - DNA, 25 bp, mus musculus
gttcccaacatggtggtgtggtaag

SEQ ID NO: 126837 - DNA, 25 bp, mus musculus
gagagcgacttactccataggaagg

SEQ ID NO: 126838 - DNA, 25 bp, mus musculus
ggtcttccaatacaagatggcttcc

SEQ ID NO: 126839 - DNA, 25 bp, mus musculus
cttccaatacaagatggcttccaga

SEQ ID NO: 126840 - DNA, 25 bp, mus musculus
gatggcttccagatacccctgttca

SEQ ID NO: 126841 - DNA, 25 bp, mus musculus
ggcttccagatacccctgttcatgt

SEQ ID NO: 126842 - DNA, 25 bp, mus musculus
cagatacccctgttcatgttttgtt

SEQ ID NO: 126843 - DNA, 25 bp, mus musculus
gtggtctgccaacctgtacaaaatg

SEQ ID NO: 126844 - DNA, 25 bp, mus musculus
gtctgccaacctgtacaaaatggtc

SEQ ID NO: 126845 - DNA, 25 bp, mus musculus
tgccaacctgtacaaaatggtccta

SEQ ID NO: 126846 - DNA, 25 bp, mus musculus
atgacaagctgtatcactgcctttg

SEQ ID NO: 126847 - DNA, 25 bp, mus musculus
agctgtatcactgcctttgtttata

SEQ ID NO: 126848 - DNA, 25 bp, mus musculus
tttaactgtgatattccccacaggc

SEQ ID NO: 126849 - DNA, 25 bp, mus musculus
tgtgatattccccacaggcacgtta

SEQ ID NO: 126850 - DNA, 25 bp, mus musculus
gatattccccacaggcacgttaact

SEQ ID NO: 126851 - DNA, 25 bp, mus musculus
cccaatggaccagctgctggcaaca

SEQ ID NO: 126852 - DNA, 25 bp, mus musculus
aatggaccagctgctggcaacaaga

SEQ ID NO: 126853 - DNA, 25 bp, mus musculus
tcacacagactgtctgcttagacga

SEQ ID NO: 126854 - DNA, 25 bp, mus musculus
cacagactgtctgcttagacgatac

SEQ ID NO: 126855 - DNA, 25 bp, mus musculus
ctgtctgcttagacgatacaacggt

SEQ ID NO: 126856 - DNA, 25 bp, mus musculus
tctgcttagacgatacaacggtcaa

SEQ ID NO: 126857 - DNA, 25 bp, mus musculus
acacagctggccaagagcgctatca

SEQ ID NO: 126858 - DNA, 25 bp, mus musculus
ctggccaagagcgctatcacagcct

SEQ ID NO: 126859 - DNA, 25 bp, mus musculus
aagagcgctatcacagcctggcccc

SEQ ID NO: 126860 - DNA, 25 bp, mus musculus
gctatcacagcctggccccgatgta

SEQ ID NO: 126861 - DNA, 25 bp, mus musculus
atcacagcctggccccgatgtacta

SEQ ID NO: 126862 - DNA, 25 bp, mus musculus
acagcctggccccgatgtactatcg

SEQ ID NO: 126863 - DNA, 25 bp, mus musculus
ggaccagctgctggcaacaagatct

SEQ ID NO: 126864 - DNA, 25 bp, mus musculus
tttaagctggtcctcttgggcgagt

SEQ ID NO: 126865 - DNA, 25 bp, mus musculus
agtccagcctggtcctccgctttgt

SEQ ID NO: 126866 - DNA, 25 bp, mus musculus
ccagcctggtcctccgctttgtcaa

SEQ ID NO: 126867 - DNA, 25 bp, mus musculus
gcctggtcctccgctttgtcaaggg

SEQ ID NO: 126868 - DNA, 25 bp, mus musculus
tccgctttgtcaaggggcagttcca

SEQ ID NO: 126869 - DNA, 25 bp, mus musculus
gagcggctttcctcacacagactgt

SEQ ID NO: 126870 - DNA, 25 bp, mus musculus
cggctttcctcacacagactgtctg

SEQ ID NO: 126871 - DNA, 25 bp, mus musculus
gatatccccgaagcatgaaagatcg

SEQ ID NO: 126872 - DNA, 25 bp, mus musculus
atccccgaagcatgaaagatcgacc

SEQ ID NO: 126873 - DNA, 25 bp, mus musculus
aaattccagctagttcaggactgtc

SEQ ID NO: 126874 - DNA, 25 bp, mus musculus
caggactgtccatacctgcacataa

SEQ ID NO: 126875 - DNA, 25 bp, mus musculus
tgtccatacctgcacataactcttg

SEQ ID NO: 126876 - DNA, 25 bp, mus musculus
ccatacctgcacataactcttggaa

SEQ ID NO: 126877 - DNA, 25 bp, mus musculus
tacctgcacataactcttggaagag

SEQ ID NO: 126878 - DNA, 25 bp, mus musculus
gaagacaagatcacccagagatacg

SEQ ID NO: 126879 - DNA, 25 bp, mus musculus
gacaagatcacccagagatacgaca

SEQ ID NO: 126880 - DNA, 25 bp, mus musculus
cagagatacgacatcctgagactca

SEQ ID NO: 126881 - DNA, 25 bp, mus musculus
agatacgacatcctgagactcatcg

SEQ ID NO: 126882 - DNA, 25 bp, mus musculus
tacgacatcctgagactcatcgcac

SEQ ID NO: 126883 - DNA, 25 bp, mus musculus
catccaagtctgtggttcatgggtt

SEQ ID NO: 126884 - DNA, 25 bp, mus musculus
ccaagtctgtggttcatgggttact

SEQ ID NO: 126885 - DNA, 25 bp, mus musculus
ctgtggttcatgggttactgggatg

SEQ ID NO: 126886 - DNA, 25 bp, mus musculus
tggttcatgggttactgggatgtcc

SEQ ID NO: 126887 - DNA, 25 bp, mus musculus
gtgtttactgctgcaagctatgagg

SEQ ID NO: 126888 - DNA, 25 bp, mus musculus
gcgacacggtacatctgtggggaca

SEQ ID NO: 126889 - DNA, 25 bp, mus musculus
tacatctgtggggacactctgacta

SEQ ID NO: 126890 - DNA, 25 bp, mus musculus
gacactctgactaagatagcaagcc

SEQ ID NO: 126891 - DNA, 25 bp, mus musculus
cgaccctttgaccatgccactcagt

SEQ ID NO: 126892 - DNA, 25 bp, mus musculus
tttgaccatgccactcagtatctca

SEQ ID NO: 126893 - DNA, 25 bp, mus musculus
cagcacccaggttcctgtctccaga

SEQ ID NO: 126894 - DNA, 25 bp, mus musculus
tcctgtctccagagcatgaattcca

SEQ ID NO: 126895 - DNA, 25 bp, mus musculus
ctccagagcatgaattccaggtcca

SEQ ID NO: 126896 - DNA, 25 bp, mus musculus
aattccaggtccaatgctagagggg

SEQ ID NO: 126897 - DNA, 25 bp, mus musculus
tttgggagactctgctcttatcctg

SEQ ID NO: 126898 - DNA, 25 bp, mus musculus
tgctcttatcctgaggactactgaa

SEQ ID NO: 126899 - DNA, 25 bp, mus musculus
cctacccagtgagatgagaactaca

SEQ ID NO: 126900 - DNA, 25 bp, mus musculus
attttgtaagcatttcctacataat

SEQ ID NO: 126901 - DNA, 25 bp, mus musculus
taagcatttcctacataatatgagt

SEQ ID NO: 126902 - DNA, 25 bp, mus musculus
tttcctacataatatgagtttctac

SEQ ID NO: 126903 - DNA, 25 bp, mus musculus
ccttgcacttgtcctcaggcaatag

SEQ ID NO: 126904 - DNA, 25 bp, mus musculus
acttgtcctcaggcaatagaatcca

SEQ ID NO: 126905 - DNA, 25 bp, mus musculus
atccctgttgctcagacctgagccc

SEQ ID NO: 126906 - DNA, 25 bp, mus musculus
cagacctgagccctccaggcagcag

SEQ ID NO: 126907 - DNA, 25 bp, mus musculus
tgagccctccaggcagcagaagctc

SEQ ID NO: 126908 - DNA, 25 bp, mus musculus
ccacctactcctgcaggcaggaatc

SEQ ID NO: 126909 - DNA, 25 bp, mus musculus
actcctgcaggcaggaatctcaggt

SEQ ID NO: 126910 - DNA, 25 bp, mus musculus
aggaatctcaggtttctcacaccct

SEQ ID NO: 126911 - DNA, 25 bp, mus musculus
gttatctggtgttcaagcagccctg

SEQ ID NO: 126912 - DNA, 25 bp, mus musculus
tggtgttcaagcagccctggccagg

SEQ ID NO: 126913 - DNA, 25 bp, mus musculus
ttgatgacatgctcaatgtgtctgg

SEQ ID NO: 126914 - DNA, 25 bp, mus musculus
acatgctcaatgtgtctggacatct

SEQ ID NO: 126915 - DNA, 25 bp, mus musculus
atgtgtctggacatctcctgagtac

SEQ ID NO: 126916 - DNA, 25 bp, mus musculus
tgtctggacatctcctgagtacagc

SEQ ID NO: 126917 - DNA, 25 bp, mus musculus
gacatctcctgagtacagcagaggt

SEQ ID NO: 126918 - DNA, 25 bp, mus musculus
atctcctgagtacagcagaggtgga

SEQ ID NO: 126919 - DNA, 25 bp, mus musculus
tcctgagtacagcagaggtggaatc

SEQ ID NO: 126920 - DNA, 25 bp, mus musculus
tggaatcggcacttgtggaacacga

SEQ ID NO: 126921 - DNA, 25 bp, mus musculus
aatcggcacttgtggaacacgaggc

SEQ ID NO: 126922 - DNA, 25 bp, mus musculus
aacacgaggctgtcgcagaggcagc

SEQ ID NO: 126923 - DNA, 25 bp, mus musculus
ggatcatgcacgcagtctatgggaa

SEQ ID NO: 126924 - DNA, 25 bp, mus musculus
tgggccacctcatcctgtgaagggc

SEQ ID NO: 126925 - DNA, 25 bp, mus musculus
tcatgcacgcagtctatgggaacca

SEQ ID NO: 126926 - DNA, 25 bp, mus musculus
tgcacgcagtctatgggaaccacac

SEQ ID NO: 126927 - DNA, 25 bp, mus musculus
tctatgggaaccacacacggtttga

SEQ ID NO: 126928 - DNA, 25 bp, mus musculus
agaagttccctggctactatgtgac

SEQ ID NO: 126929 - DNA, 25 bp, mus musculus
tccctggctactatgtgaccggaga

SEQ ID NO: 126930 - DNA, 25 bp, mus musculus
ctggctactatgtgaccggagatgg

SEQ ID NO: 126931 - DNA, 25 bp, mus musculus
gctattactggatcacgggcaggat

SEQ ID NO: 126932 - DNA, 25 bp, mus musculus
aggctctgcaggtctctgctttggg

SEQ ID NO: 126933 - DNA, 25 bp, mus musculus
ctgtctctcctgctggctcagggaa

SEQ ID NO: 126934 - DNA, 25 bp, mus musculus
ttcctacttctcaatacccttgcaa

SEQ ID NO: 126935 - DNA, 25 bp, mus musculus
ctacttctcaatacccttgcaatgg

SEQ ID NO: 126936 - DNA, 25 bp, mus musculus
ctcaatacccttgcaatggcagtgg

SEQ ID NO: 126937 - DNA, 25 bp, mus musculus
acccttgcaatggcagtggaaattt

SEQ ID NO: 126938 - DNA, 25 bp, mus musculus
tgcatcctaacccgtgttttcaatg

SEQ ID NO: 126939 - DNA, 25 bp, mus musculus
gctttgacgtttgtgctaaggagac

SEQ ID NO: 126940 - DNA, 25 bp, mus musculus
ttgacgtttgtgctaaggagacaca

SEQ ID NO: 126941 - DNA, 25 bp, mus musculus
gaatagtgcccaaggtacagtcctg

SEQ ID NO: 126942 - DNA, 25 bp, mus musculus
tagtgcccaaggtacagtcctgacc

SEQ ID NO: 126943 - DNA, 25 bp, mus musculus
tgcccaaggtacagtcctgacctca

SEQ ID NO: 126944 - DNA, 25 bp, mus musculus
agtgtctgacccacttatctatggg

SEQ ID NO: 126945 - DNA, 25 bp, mus musculus
gtctgacccacttatctatgggaaa

SEQ ID NO: 126946 - DNA, 25 bp, mus musculus
tgacccacttatctatgggaaaagg

SEQ ID NO: 126947 - DNA, 25 bp, mus musculus
tctgcccagatgcaagctgatctcg

SEQ ID NO: 126948 - DNA, 25 bp, mus musculus
taacaacacagttaatctgaacaca

SEQ ID NO: 126949 - DNA, 25 bp, mus musculus
agttaatctgaacacaggagatgtg

SEQ ID NO: 126950 - DNA, 25 bp, mus musculus
taatctgaacacaggagatgtggga

SEQ ID NO: 126951 - DNA, 25 bp, mus musculus
atgaagtcattcctacttctcaata

SEQ ID NO: 126952 - DNA, 25 bp, mus musculus
agcacctgcacaaacatgtatatac

SEQ ID NO: 126953 - DNA, 25 bp, mus musculus
aacatgtatatacccacgaatagac

SEQ ID NO: 126954 - DNA, 25 bp, mus musculus
tagggtgaccactctgaagtggcac

SEQ ID NO: 126955 - DNA, 25 bp, mus musculus
gaccactctgaagtggcacatttca

SEQ ID NO: 126956 - DNA, 25 bp, mus musculus
cactctgaagtggcacatttcactt

SEQ ID NO: 126957 - DNA, 25 bp, mus musculus
gcacatttcactttaaccactaaga

SEQ ID NO: 126958 - DNA, 25 bp, mus musculus
ataatattgctgtcactctggccct

SEQ ID NO: 126959 - DNA, 25 bp, mus musculus
atattgctgtcactctggcccttag

SEQ ID NO: 126960 - DNA, 25 bp, mus musculus
ttgctgtcactctggcccttagctg

SEQ ID NO: 126961 - DNA, 25 bp, mus musculus
ctgtcactctggcccttagctgatg

SEQ ID NO: 126962 - DNA, 25 bp, mus musculus
ctctggcccttagctgatggggaca

SEQ ID NO: 126963 - DNA, 25 bp, mus musculus
tggcccttagctgatggggacacac

SEQ ID NO: 126964 - DNA, 25 bp, mus musculus
atgtatatacccacgaatagacacg

SEQ ID NO: 126965 - DNA, 25 bp, mus musculus
atacccacgaatagacacgcatttg

SEQ ID NO: 126966 - DNA, 25 bp, mus musculus
cccacgaatagacacgcatttgtaa

SEQ ID NO: 126967 - DNA, 25 bp, mus musculus
aatagacacgcatttgtaattaagc

SEQ ID NO: 126968 - DNA, 25 bp, mus musculus
agtgtgtcagcttccatgctatggg

SEQ ID NO: 126969 - DNA, 25 bp, mus musculus
gtgtcagcttccatgctatggggtt

SEQ ID NO: 126970 - DNA, 25 bp, mus musculus
tcagcttccatgctatggggttgct

SEQ ID NO: 126971 - DNA, 25 bp, mus musculus
gcttccatgctatggggttgctgat

SEQ ID NO: 126972 - DNA, 25 bp, mus musculus
gctcagcgccatgaagatggagact

SEQ ID NO: 126973 - DNA, 25 bp, mus musculus
catgactctggaaggcgacgacctc

SEQ ID NO: 126974 - DNA, 25 bp, mus musculus
ccatgggacagcacacacactacct

SEQ ID NO: 126975 - DNA, 25 bp, mus musculus
gacagcacacacactacctgcaatg

SEQ ID NO: 126976 - DNA, 25 bp, mus musculus
acacacactacctgcaatggcctgc

SEQ ID NO: 126977 - DNA, 25 bp, mus musculus
tgcaatggcctgcccattcccttca

SEQ ID NO: 126978 - DNA, 25 bp, mus musculus
cccattcccttcagctatttgtcct

SEQ ID NO: 126979 - DNA, 25 bp, mus musculus
cacatattcatctcttgccaaataa

SEQ ID NO: 126980 - DNA, 25 bp, mus musculus
ttcatctcttgccaaataagggcct

SEQ ID NO: 126981 - DNA, 25 bp, mus musculus
caaataagggcctgctcctcgtggg

SEQ ID NO: 126982 - DNA, 25 bp, mus musculus
tgctcctcgtgggagaccacaggtg

SEQ ID NO: 126983 - DNA, 25 bp, mus musculus
attcacaggtcctgggaaatttgct

SEQ ID NO: 126984 - DNA, 25 bp, mus musculus
aggcgacgacctcatcctagagatt

SEQ ID NO: 126985 - DNA, 25 bp, mus musculus
ctccacactaggtcatgtacagtct

SEQ ID NO: 126986 - DNA, 25 bp, mus musculus
atcttactccagcctggcagcctgg

SEQ ID NO: 126987 - DNA, 25 bp, mus musculus
ccaagcctctcaacagaagctgtgc

SEQ ID NO: 126988 - DNA, 25 bp, mus musculus
ctctcaacagaagctgtgcagccag

SEQ ID NO: 126989 - DNA, 25 bp, mus musculus
acagaagctgtgcagccagggcagg

SEQ ID NO: 126990 - DNA, 25 bp, mus musculus
gcccaggccagccagtacctgagag

SEQ ID NO: 126991 - DNA, 25 bp, mus musculus
gccagccagtacctgagagtaggaa

SEQ ID NO: 126992 - DNA, 25 bp, mus musculus
cctgtcccatgggacagcacacaca

SEQ ID NO: 126993 - DNA, 25 bp, mus musculus
gtttagtccagccaggcacgtggct

SEQ ID NO: 126994 - DNA, 25 bp, mus musculus
ttagtccagccaggcacgtggctgg

SEQ ID NO: 126995 - DNA, 25 bp, mus musculus
aaatcaccattacggtcaggatggg

SEQ ID NO: 126996 - DNA, 25 bp, mus musculus
aaccgcctctctgtgcgatccatct

SEQ ID NO: 126997 - DNA, 25 bp, mus musculus
ctctgtgcgatccatctggcgatgt

SEQ ID NO: 126998 - DNA, 25 bp, mus musculus
tctgtgcgatccatctggcgatgta

SEQ ID NO: 126999 - DNA, 25 bp, mus musculus
gtgcgatccatctggcgatgtaatg

SEQ ID NO: 127000 - DNA, 25 bp, mus musculus
gcgatccatctggcgatgtaatgat

SEQ ID NO: 127001 - DNA, 25 bp, mus musculus
tccatctggcgatgtaatgatgcag

SEQ ID NO: 127002 - DNA, 25 bp, mus musculus
atgatatcagccaaaaagcaggtca

SEQ ID NO: 127003 - DNA, 25 bp, mus musculus
tgatatcagccaaaaagcaggtcac

SEQ ID NO: 127004 - DNA, 25 bp, mus musculus
gtcaaaccacgctggtagacgtaca

SEQ ID NO: 127005 - DNA, 25 bp, mus musculus
agtgggtccccgggagtcatgatct

SEQ ID NO: 127006 - DNA, 25 bp, mus musculus
gtccccgggagtcatgatctgaaga

SEQ ID NO: 127007 - DNA, 25 bp, mus musculus
agaatctgtgtaccacgaattggcc

SEQ ID NO: 127008 - DNA, 25 bp, mus musculus
aatctgtgtaccacgaattggccca

SEQ ID NO: 127009 - DNA, 25 bp, mus musculus
ctgtgtaccacgaattggcccaaca

SEQ ID NO: 127010 - DNA, 25 bp, mus musculus
tgtgtaccacgaattggcccaacag

SEQ ID NO: 127011 - DNA, 25 bp, mus musculus
tgtaccacgaattggcccaacagaa

SEQ ID NO: 127012 - DNA, 25 bp, mus musculus
caccaaaaatcaccattacggtcag

SEQ ID NO: 127013 - DNA, 25 bp, mus musculus
caaacagttctttgtggctgtggaa

SEQ ID NO: 127014 - DNA, 25 bp, mus musculus
tgatactctatgtgatctctatgac

SEQ ID NO: 127015 - DNA, 25 bp, mus musculus
catcttctgcaacaccaagcggaag

SEQ ID NO: 127016 - DNA, 25 bp, mus musculus
tcttctgcaacaccaagcggaaggt

SEQ ID NO: 127017 - DNA, 25 bp, mus musculus
ttctgcaacaccaagcggaaggttg

SEQ ID NO: 127018 - DNA, 25 bp, mus musculus
gaagccaatttcactgtcgtccatg

SEQ ID NO: 127019 - DNA, 25 bp, mus musculus
agccaatttcactgtcgtccatgca

SEQ ID NO: 127020 - DNA, 25 bp, mus musculus
ccaatttcactgtcgtccatgcatg

SEQ ID NO: 127021 - DNA, 25 bp, mus musculus
aatttcactgtcgtccatgcatgga

SEQ ID NO: 127022 - DNA, 25 bp, mus musculus
tttcactgtcgtccatgcatggaga

SEQ ID NO: 127023 - DNA, 25 bp, mus musculus
ttccggtcaggtgccagccgggtgc

SEQ ID NO: 127024 - DNA, 25 bp, mus musculus
tcaggtgccagccgggtgctcatct

SEQ ID NO: 127025 - DNA, 25 bp, mus musculus
actctatgtgatctctatgacacgc

SEQ ID NO: 127026 - DNA, 25 bp, mus musculus
tgtgatctctatgacacgctgacca

SEQ ID NO: 127027 - DNA, 25 bp, mus musculus
tgatctctatgacacgctgaccatc

SEQ ID NO: 127028 - DNA, 25 bp, mus musculus
atcacccaggccgtcatcttctgca

SEQ ID NO: 127029 - DNA, 25 bp, mus musculus
caggccgtcatcttctgcaacacca

SEQ ID NO: 127030 - DNA, 25 bp, mus musculus
ggccgtcatcttctgcaacaccaag

SEQ ID NO: 127031 - DNA, 25 bp, mus musculus
ccgtcatcttctgcaacaccaagcg

SEQ ID NO: 127032 - DNA, 25 bp, mus musculus
gtcatcttctgcaacaccaagcgga

SEQ ID NO: 127033 - DNA, 25 bp, mus musculus
tttgcactccacctgaaccagcctg

SEQ ID NO: 127034 - DNA, 25 bp, mus musculus
ctgaaccagcctgggcctgatgcta

SEQ ID NO: 127035 - DNA, 25 bp, mus musculus
tttgtgaaccacgtgccaggccact

SEQ ID NO: 127036 - DNA, 25 bp, mus musculus
aaccacgtgccaggccactgcgagt

SEQ ID NO: 127037 - DNA, 25 bp, mus musculus
ggccactgcgagtctgggttgtcta

SEQ ID NO: 127038 - DNA, 25 bp, mus musculus
ttgtctattgcttgccaagaagaac

SEQ ID NO: 127039 - DNA, 25 bp, mus musculus
tcgggctcaactatgcccaccaggc

SEQ ID NO: 127040 - DNA, 25 bp, mus musculus
ttttgctctgggaagctctgggcaa

SEQ ID NO: 127041 - DNA, 25 bp, mus musculus
tagcccagatgccagccaaggtccg

SEQ ID NO: 127042 - DNA, 25 bp, mus musculus
agatgccagccaaggtccgctgagc

SEQ ID NO: 127043 - DNA, 25 bp, mus musculus
cagccaaggtccgctgagcctgcag

SEQ ID NO: 127044 - DNA, 25 bp, mus musculus
ttccactatcggaggtgcttgttta

SEQ ID NO: 127045 - DNA, 25 bp, mus musculus
cagcctgggcctgatgctacacaca

SEQ ID NO: 127046 - DNA, 25 bp, mus musculus
gatgctacacacagtgctcccagtc

SEQ ID NO: 127047 - DNA, 25 bp, mus musculus
acacacagtgctcccagtcgatgtt

SEQ ID NO: 127048 - DNA, 25 bp, mus musculus
tgccttgagtccaagacatacaggg

SEQ ID NO: 127049 - DNA, 25 bp, mus musculus
tgttagcttatccttctgaggaccc

SEQ ID NO: 127050 - DNA, 25 bp, mus musculus
tacttcatgctttagcaatggctgt

SEQ ID NO: 127051 - DNA, 25 bp, mus musculus
tagcctgctaccgacactcaagggc

SEQ ID NO: 127052 - DNA, 25 bp, mus musculus
gctaccgacactcaagggcagctcc

SEQ ID NO: 127053 - DNA, 25 bp, mus musculus
ttaggagccgctctgcttttgaaca

SEQ ID NO: 127054 - DNA, 25 bp, mus musculus
gccgctctgcttttgaacaacagca

SEQ ID NO: 127055 - DNA, 25 bp, mus musculus
gctgctctcgaagggtcaatcgcag

SEQ ID NO: 127056 - DNA, 25 bp, mus musculus
actctactgcctctgtcagccgtgg

SEQ ID NO: 127057 - DNA, 25 bp, mus musculus
agctagacacactagcaggtcttcg

SEQ ID NO: 127058 - DNA, 25 bp, mus musculus
acacactagcaggtcttcggaggag

SEQ ID NO: 127059 - DNA, 25 bp, mus musculus
agccccacgacagccttgacctgaa

SEQ ID NO: 127060 - DNA, 25 bp, mus musculus
acgacagccttgacctgaactgtga

SEQ ID NO: 127061 - DNA, 25 bp, mus musculus
actgtgacagccgggacttcgtggc

SEQ ID NO: 127062 - DNA, 25 bp, mus musculus
ccaacacgccagatgaaagtcaacc

SEQ ID NO: 127063 - DNA, 25 bp, mus musculus
ctctcaggaactccagcttgggtac

SEQ ID NO: 127064 - DNA, 25 bp, mus musculus
tccctgagactgtcaagatctcttc

SEQ ID NO: 127065 - DNA, 25 bp, mus musculus
aacagcatcaccatctgctgcattg

SEQ ID NO: 127066 - DNA, 25 bp, mus musculus
gactgtcaagatctcttccctgtga

SEQ ID NO: 127067 - DNA, 25 bp, mus musculus
agaagactacgtgtcacgagttcac

SEQ ID NO: 127068 - DNA, 25 bp, mus musculus
ctacgtgtcacgagttcacagacga

SEQ ID NO: 127069 - DNA, 25 bp, mus musculus
ccagccgcagtacctcagtatcatc

SEQ ID NO: 127070 - DNA, 25 bp, mus musculus
cctcagtatcatcccaaccaatggg

SEQ ID NO: 127071 - DNA, 25 bp, mus musculus
tatcatcccaaccaatggggcctgg

SEQ ID NO: 127072 - DNA, 25 bp, mus musculus
ggagcctgttctcatcctgctgctc

SEQ ID NO: 127073 - DNA, 25 bp, mus musculus
tgttctcatcctgctgctctcgaag

SEQ ID NO: 127074 - DNA, 25 bp, mus musculus
cacacaagctataccagcataacta

SEQ ID NO: 127075 - DNA, 25 bp, mus musculus
acaagctataccagcataactattg

SEQ ID NO: 127076 - DNA, 25 bp, mus musculus
ttccacaataacagcaggaaatata

SEQ ID NO: 127077 - DNA, 25 bp, mus musculus
aggatgaccaagctggctgctcgtc

SEQ ID NO: 127078 - DNA, 25 bp, mus musculus
atgaccaagctggctgctcgtcctt

SEQ ID NO: 127079 - DNA, 25 bp, mus musculus
accaagctggctgctcgtccttcat

SEQ ID NO: 127080 - DNA, 25 bp, mus musculus
aagctggctgctcgtccttcattgg

SEQ ID NO: 127081 - DNA, 25 bp, mus musculus
cgtccttcattggcgttactttgca

SEQ ID NO: 127082 - DNA, 25 bp, mus musculus
ccttcattggcgttactttgcaaat

SEQ ID NO: 127083 - DNA, 25 bp, mus musculus
tcattggcgttactttgcaaattgc

SEQ ID NO: 127084 - DNA, 25 bp, mus musculus
aaattgcagatcacttaggtcggtt

SEQ ID NO: 127085 - DNA, 25 bp, mus musculus
ttgcagatcacttaggtcggttcct

SEQ ID NO: 127086 - DNA, 25 bp, mus musculus
agctataccagcataactattgaga

SEQ ID NO: 127087 - DNA, 25 bp, mus musculus
cagatcacttaggtcggttcctgtt

SEQ ID NO: 127088 - DNA, 25 bp, mus musculus
gagaatatcagcaccaggaacatgt

SEQ ID NO: 127089 - DNA, 25 bp, mus musculus
aatatcagcaccaggaacatgttcc

SEQ ID NO: 127090 - DNA, 25 bp, mus musculus
atcagcaccaggaacatgttccaca

SEQ ID NO: 127091 - DNA, 25 bp, mus musculus
agcaccaggaacatgttccacaata

SEQ ID NO: 127092 - DNA, 25 bp, mus musculus
accaggaacatgttccacaataaca

SEQ ID NO: 127093 - DNA, 25 bp, mus musculus
aacatgttccacaataacagcagga

SEQ ID NO: 127094 - DNA, 25 bp, mus musculus
atgttccacaataacagcaggaaat

SEQ ID NO: 127095 - DNA, 25 bp, mus musculus
gcccatgagtacccacatggctaac

SEQ ID NO: 127096 - DNA, 25 bp, mus musculus
gagtacccacatggctaaccagatc

SEQ ID NO: 127097 - DNA, 25 bp, mus musculus
taaagcctgacaaacttcataaatg

SEQ ID NO: 127098 - DNA, 25 bp, mus musculus
ctgacaaacttcataaatggtgacg

SEQ ID NO: 127099 - DNA, 25 bp, mus musculus
cctcttacatgctgaatcactggtg

SEQ ID NO: 127100 - DNA, 25 bp, mus musculus
acatgctgaatcactggtgaaaatt

SEQ ID NO: 127101 - DNA, 25 bp, mus musculus
atactgcttccatgtattttggaaa

SEQ ID NO: 127102 - DNA, 25 bp, mus musculus
tgccagatatcttcccatatatcac

SEQ ID NO: 127103 - DNA, 25 bp, mus musculus
atatcttcccatatatcacagcaat

SEQ ID NO: 127104 - DNA, 25 bp, mus musculus
tcccatatatcacagcaatgcaaaa

SEQ ID NO: 127105 - DNA, 25 bp, mus musculus
tagtggccagattccttgatgcaca

SEQ ID NO: 127106 - DNA, 25 bp, mus musculus
ccagattccttgatgcacatttctc

SEQ ID NO: 127107 - DNA, 25 bp, mus musculus
ccacatggctaaccagatcaaccaa

SEQ ID NO: 127108 - DNA, 25 bp, mus musculus
ggctaaccagatcaaccaatataaa

SEQ ID NO: 127109 - DNA, 25 bp, mus musculus
atataaatccacaagcagcctgatc

SEQ ID NO: 127110 - DNA, 25 bp, mus musculus
aagcagcctgatccctccaatcaga

SEQ ID NO: 127111 - DNA, 25 bp, mus musculus
cctgatccctccaatcagagaagtt

SEQ ID NO: 127112 - DNA, 25 bp, mus musculus
ccctccaatcagagaagttgaagat

SEQ ID NO: 127113 - DNA, 25 bp, mus musculus
tgaatgttgactcccaggagaccag

SEQ ID NO: 127114 - DNA, 25 bp, mus musculus
ttgactcccaggagaccagaactat

SEQ ID NO: 127115 - DNA, 25 bp, mus musculus
cgcagactcgctggccaacgggcgc

SEQ ID NO: 127116 - DNA, 25 bp, mus musculus
gcgctccagcaagcggcggccgtcg

SEQ ID NO: 127117 - DNA, 25 bp, mus musculus
cttccgcaaggctttccagcgcctg

SEQ ID NO: 127118 - DNA, 25 bp, mus musculus
caaggctttccagcgcctgctctgc

SEQ ID NO: 127119 - DNA, 25 bp, mus musculus
ggctttccagcgcctgctctgctgc

SEQ ID NO: 127120 - DNA, 25 bp, mus musculus
tttccagcgcctgctctgctgcgcg

SEQ ID NO: 127121 - DNA, 25 bp, mus musculus
cgggacaaccactgtggacagcgat

SEQ ID NO: 127122 - DNA, 25 bp, mus musculus
gacaaccactgtggacagcgattcg

SEQ ID NO: 127123 - DNA, 25 bp, mus musculus
aaccactgtggacagcgattcgagc

SEQ ID NO: 127124 - DNA, 25 bp, mus musculus
ctcctcggagtccaaggtgtagaga

SEQ ID NO: 127125 - DNA, 25 bp, mus musculus
cctcggagtccaaggtgtagagagc

SEQ ID NO: 127126 - DNA, 25 bp, mus musculus
tagagagccaggctctctgggcgca

SEQ ID NO: 127127 - DNA, 25 bp, mus musculus
ggctctgcgcgagcagaaggcgctc

SEQ ID NO: 127128 - DNA, 25 bp, mus musculus
ggcgctcaagacactgggcatcatc

SEQ ID NO: 127129 - DNA, 25 bp, mus musculus
gacactgggcatcatcatgggtgtg

SEQ ID NO: 127130 - DNA, 25 bp, mus musculus
actgggcatcatcatgggtgtgttc

SEQ ID NO: 127131 - DNA, 25 bp, mus musculus
gggcatcatcatgggtgtgttcacg

SEQ ID NO: 127132 - DNA, 25 bp, mus musculus
cttcttcctggccaacgtggtgaag

SEQ ID NO: 127133 - DNA, 25 bp, mus musculus
cttcctggccaacgtggtgaaggct

SEQ ID NO: 127134 - DNA, 25 bp, mus musculus
cttcttcaactggctgggctacgcc

SEQ ID NO: 127135 - DNA, 25 bp, mus musculus
gaccattctgctagatgccctactc

SEQ ID NO: 127136 - DNA, 25 bp, mus musculus
agatgccctactccctgtgggtgaa

SEQ ID NO: 127137 - DNA, 25 bp, mus musculus
agccacttgtgagtggcagggagat

SEQ ID NO: 127138 - DNA, 25 bp, mus musculus
tgtaccatcagctcctggccagctg

SEQ ID NO: 127139 - DNA, 25 bp, mus musculus
atcagctcctggccagctgagggtg

SEQ ID NO: 127140 - DNA, 25 bp, mus musculus
tcctggccagctgagggtgccaaag

SEQ ID NO: 127141 - DNA, 25 bp, mus musculus
aatgtatctggtgcccacttgggat

SEQ ID NO: 127142 - DNA, 25 bp, mus musculus
tgcacagggcccaagccaagcttct

SEQ ID NO: 127143 - DNA, 25 bp, mus musculus
aagccaagcttctcagggcctcctc

SEQ ID NO: 127144 - DNA, 25 bp, mus musculus
agcttctcagggcctcctcagtggg

SEQ ID NO: 127145 - DNA, 25 bp, mus musculus
ctccagctggagccctcgactcttg

SEQ ID NO: 127146 - DNA, 25 bp, mus musculus
ctggagccctcgactcttgtaaata

SEQ ID NO: 127147 - DNA, 25 bp, mus musculus
tggtagccacttccttggtgctacc

SEQ ID NO: 127148 - DNA, 25 bp, mus musculus
ccacttccttggtgctaccaacttg

SEQ ID NO: 127149 - DNA, 25 bp, mus musculus
tgctaccaacttggtgtacatagct

SEQ ID NO: 127150 - DNA, 25 bp, mus musculus
catagcttttctcagccgccgagga

SEQ ID NO: 127151 - DNA, 25 bp, mus musculus
ttttctcagccgccgaggactgcct

SEQ ID NO: 127152 - DNA, 25 bp, mus musculus
cagccgccgaggactgcctgagcca

SEQ ID NO: 127153 - DNA, 25 bp, mus musculus
ccgaggactgcctgagccagccact

SEQ ID NO: 127154 - DNA, 25 bp, mus musculus
actgcctgagccagccacttgtgag

SEQ ID NO: 127155 - DNA, 25 bp, mus musculus
atggcaacaggccgtccttcacctg

SEQ ID NO: 127156 - DNA, 25 bp, mus musculus
gcctcacctgtaatgccaccacaaa

SEQ ID NO: 127157 - DNA, 25 bp, mus musculus
ggccttgaccctgtggagatcctac

SEQ ID NO: 127158 - DNA, 25 bp, mus musculus
gagatcctacaagagcgggagtaca

SEQ ID NO: 127159 - DNA, 25 bp, mus musculus
atcctacaagagcgggagtacaggc

SEQ ID NO: 127160 - DNA, 25 bp, mus musculus
gagtacaggcttcaggctcgaatcg

SEQ ID NO: 127161 - DNA, 25 bp, mus musculus
tacaggcttcaggctcgaatcgcac

SEQ ID NO: 127162 - DNA, 25 bp, mus musculus
aggcttcaggctcgaatcgcacaca

SEQ ID NO: 127163 - DNA, 25 bp, mus musculus
caggctcgaatcgcacacagaattc

SEQ ID NO: 127164 - DNA, 25 bp, mus musculus
gctcgaatcgcacacagaattcagg

SEQ ID NO: 127165 - DNA, 25 bp, mus musculus
cgaatcgcacacagaattcaggaac

SEQ ID NO: 127166 - DNA, 25 bp, mus musculus
atcgcacacagaattcaggaacttg

SEQ ID NO: 127167 - DNA, 25 bp, mus musculus
tcacctgtaatgccaccacaaacac

SEQ ID NO: 127168 - DNA, 25 bp, mus musculus
gtaatgccaccacaaacacagtccc

SEQ ID NO: 127169 - DNA, 25 bp, mus musculus
cagcctgctccattggtgccactgc

SEQ ID NO: 127170 - DNA, 25 bp, mus musculus
gctccattggtgccactgcaccaga

SEQ ID NO: 127171 - DNA, 25 bp, mus musculus
ccattggtgccactgcaccagaagc

SEQ ID NO: 127172 - DNA, 25 bp, mus musculus
ttggtgccactgcaccagaagcaga

SEQ ID NO: 127173 - DNA, 25 bp, mus musculus
gtgccactgcaccagaagcagagcc

SEQ ID NO: 127174 - DNA, 25 bp, mus musculus
ctgcaccagaagcagagccgaatca

SEQ ID NO: 127175 - DNA, 25 bp, mus musculus
tacccagagcttgcacattttctag

SEQ ID NO: 127176 - DNA, 25 bp, mus musculus
gagcttgcacattttctagtctaac

SEQ ID NO: 127177 - DNA, 25 bp, mus musculus
cctcacacttgtatacctgcatttt

SEQ ID NO: 127178 - DNA, 25 bp, mus musculus
atacctgcattttatccactaagac

SEQ ID NO: 127179 - DNA, 25 bp, mus musculus
gcattttatccactaagacatctct

SEQ ID NO: 127180 - DNA, 25 bp, mus musculus
tatccactaagacatctctccaagg

SEQ ID NO: 127181 - DNA, 25 bp, mus musculus
agagacctgattcctgcaagttgtc

SEQ ID NO: 127182 - DNA, 25 bp, mus musculus
tacatgcttctgcatatgtgcacac

SEQ ID NO: 127183 - DNA, 25 bp, mus musculus
cttctgcatatgtgcacacatcaca

SEQ ID NO: 127184 - DNA, 25 bp, mus musculus
tgcacacatcacattcttgcacaca

SEQ ID NO: 127185 - DNA, 25 bp, mus musculus
catcacattcttgcacacacactca

SEQ ID NO: 127186 - DNA, 25 bp, mus musculus
attcttgcacacacactcacatacc

SEQ ID NO: 127187 - DNA, 25 bp, mus musculus
gcacattttctagtctaacttgctt

SEQ ID NO: 127188 - DNA, 25 bp, mus musculus
gtctaacttgcttcagggatctctg

SEQ ID NO: 127189 - DNA, 25 bp, mus musculus
cttgcttcagggatctctgtctgcc

SEQ ID NO: 127190 - DNA, 25 bp, mus musculus
atctctgtctgcctatggagtgctc

SEQ ID NO: 127191 - DNA, 25 bp, mus musculus
agtgctcaggttacaggcaggctgc

SEQ ID NO: 127192 - DNA, 25 bp, mus musculus
ccatacctgcccgacatttacatga

SEQ ID NO: 127193 - DNA, 25 bp, mus musculus
ctgcccgacatttacatgaatacta

SEQ ID NO: 127194 - DNA, 25 bp, mus musculus
tctggtcctcacacttgtatacctg

SEQ ID NO: 127195 - DNA, 25 bp, mus musculus
gagactgcaaacacccaaacattgt

SEQ ID NO: 127196 - DNA, 25 bp, mus musculus
actgcaaacacccaaacattgttgc

SEQ ID NO: 127197 - DNA, 25 bp, mus musculus
ctggacccctttcagaactgcagat

SEQ ID NO: 127198 - DNA, 25 bp, mus musculus
gacccctttcagaactgcagattgc

SEQ ID NO: 127199 - DNA, 25 bp, mus musculus
ccctttcagaactgcagattgcata

SEQ ID NO: 127200 - DNA, 25 bp, mus musculus
tttcagaactgcagattgcatatgt

SEQ ID NO: 127201 - DNA, 25 bp, mus musculus
gattgtattaccttcacagtaaagg

SEQ ID NO: 127202 - DNA, 25 bp, mus musculus
gcgctaacattctcctaacggataa

SEQ ID NO: 127203 - DNA, 25 bp, mus musculus
ctaacattctcctaacggataatgg

SEQ ID NO: 127204 - DNA, 25 bp, mus musculus
acattctcctaacggataatggtca

SEQ ID NO: 127205 - DNA, 25 bp, mus musculus
ttctcctaacggataatggtcacgt

SEQ ID NO: 127206 - DNA, 25 bp, mus musculus
tctcctaacggataatggtcacgtg

SEQ ID NO: 127207 - DNA, 25 bp, mus musculus
gcaaacacccaaacattgttgctta

SEQ ID NO: 127208 - DNA, 25 bp, mus musculus
acattgttgcttattttggaagcta

SEQ ID NO: 127209 - DNA, 25 bp, mus musculus
attttggaagctatctcaggcgaga

SEQ ID NO: 127210 - DNA, 25 bp, mus musculus
gaagctatctcaggcgagataaact

SEQ ID NO: 127211 - DNA, 25 bp, mus musculus
gctatctcaggcgagataaactttg

SEQ ID NO: 127212 - DNA, 25 bp, mus musculus
gctctttacaggacatatatcatgt

SEQ ID NO: 127213 - DNA, 25 bp, mus musculus
atcatgtaactggacccctttcaga

SEQ ID NO: 127214 - DNA, 25 bp, mus musculus
taactggacccctttcagaactgca

SEQ ID NO: 127215 - DNA, 25 bp, mus musculus
gtgtgccagtgccgccgaaagagct

SEQ ID NO: 127216 - DNA, 25 bp, mus musculus
cagtgccgccgaaagagctatgggc

SEQ ID NO: 127217 - DNA, 25 bp, mus musculus
gtgaccacttctgccaacttgtagg

SEQ ID NO: 127218 - DNA, 25 bp, mus musculus
ggcagctttggcggtctgctccctc

SEQ ID NO: 127219 - DNA, 25 bp, mus musculus
atctgggctggtgagccaggacttc

SEQ ID NO: 127220 - DNA, 25 bp, mus musculus
ggacttctggtaggctgttcatgcc

SEQ ID NO: 127221 - DNA, 25 bp, mus musculus
ggctgttcatgccctttgtcaagcg

SEQ ID NO: 127222 - DNA, 25 bp, mus musculus
tcatgccctttgtcaagcgcctcaa

SEQ ID NO: 127223 - DNA, 25 bp, mus musculus
cctttgtcaagcgcctcaactacgt

SEQ ID NO: 127224 - DNA, 25 bp, mus musculus
tcaagcgcctcaactacgtaagcct

SEQ ID NO: 127225 - DNA, 25 bp, mus musculus
cagttagtggtggctctcagaagga

SEQ ID NO: 127226 - DNA, 25 bp, mus musculus
gctctcagaaggactggcctggaaa

SEQ ID NO: 127227 - DNA, 25 bp, mus musculus
cagctggacatctttccaacccagg

SEQ ID NO: 127228 - DNA, 25 bp, mus musculus
gacatctttccaacccaggacacct

SEQ ID NO: 127229 - DNA, 25 bp, mus musculus
acccaggacacctaccatcctatga

SEQ ID NO: 127230 - DNA, 25 bp, mus musculus
agtaccaagcgtcagccctatgagg

SEQ ID NO: 127231 - DNA, 25 bp, mus musculus
aagcgtcagccctatgaggaggttt

SEQ ID NO: 127232 - DNA, 25 bp, mus musculus
ggcagtagcagtctctcttatacca

SEQ ID NO: 127233 - DNA, 25 bp, mus musculus
agcagtctctcttataccaacccag

SEQ ID NO: 127234 - DNA, 25 bp, mus musculus
tataccaacccagctgtggtgacca

SEQ ID NO: 127235 - DNA, 25 bp, mus musculus
atctccagttctttcatcatgtgac

SEQ ID NO: 127236 - DNA, 25 bp, mus musculus
atgtgactgatctcatcctctgcta

SEQ ID NO: 127237 - DNA, 25 bp, mus musculus
agcagacagctacttagcgcgtcaa

SEQ ID NO: 127238 - DNA, 25 bp, mus musculus
ctacttagcgcgtcaatgcgatcga

SEQ ID NO: 127239 - DNA, 25 bp, mus musculus
cttagcgcgtcaatgcgatcgatca

SEQ ID NO: 127240 - DNA, 25 bp, mus musculus
agcgcgtcaatgcgatcgatcatcc

SEQ ID NO: 127241 - DNA, 25 bp, mus musculus
tcaatgcgatcgatcatcctcggca

SEQ ID NO: 127242 - DNA, 25 bp, mus musculus
atgcgatcgatcatcctcggcatgt

SEQ ID NO: 127243 - DNA, 25 bp, mus musculus
cgatcgatcatcctcggcatgttta

SEQ ID NO: 127244 - DNA, 25 bp, mus musculus
atgtttaaccggtcgtagacatctg

SEQ ID NO: 127245 - DNA, 25 bp, mus musculus
tagacatctgttggtatctgatgaa

SEQ ID NO: 127246 - DNA, 25 bp, mus musculus
acatctgttggtatctgatgaaata

SEQ ID NO: 127247 - DNA, 25 bp, mus musculus
ctgatctcatcctctgctagatcca

SEQ ID NO: 127248 - DNA, 25 bp, mus musculus
catctgttggtatctgatgaaatat

SEQ ID NO: 127249 - DNA, 25 bp, mus musculus
tcatcctctgctagatccactttac

SEQ ID NO: 127250 - DNA, 25 bp, mus musculus
tcctctgctagatccactttaccca

SEQ ID NO: 127251 - DNA, 25 bp, mus musculus
agctaatcctggatctagggcgaaa

SEQ ID NO: 127252 - DNA, 25 bp, mus musculus
taatcctggatctagggcgaaatcc

SEQ ID NO: 127253 - DNA, 25 bp, mus musculus
gaaatccccagtctaagcagacagc

SEQ ID NO: 127254 - DNA, 25 bp, mus musculus
cccagtctaagcagacagctactta

SEQ ID NO: 127255 - DNA, 25 bp, mus musculus
ctaagcagacagctacttagcgcgt

SEQ ID NO: 127256 - DNA, 25 bp, mus musculus
ttcggcacgcgggtgaacggcacct

SEQ ID NO: 127257 - DNA, 25 bp, mus musculus
gggaactctagccagcagcagcgga

SEQ ID NO: 127258 - DNA, 25 bp, mus musculus
agatcagcttccgccacaagcagca

SEQ ID NO: 127259 - DNA, 25 bp, mus musculus
gccacaagcagcaactcacgctgca

SEQ ID NO: 127260 - DNA, 25 bp, mus musculus
caagcagcaactcacgctgcaccag

SEQ ID NO: 127261 - DNA, 25 bp, mus musculus
agcagcaactcacgctgcaccagcg

SEQ ID NO: 127262 - DNA, 25 bp, mus musculus
gcatccaccgggtacgcagcggcta

SEQ ID NO: 127263 - DNA, 25 bp, mus musculus
atccaccgggtacgcagcggctatg

SEQ ID NO: 127264 - DNA, 25 bp, mus musculus
ccaccgggtacgcagcggctatgct

SEQ ID NO: 127265 - DNA, 25 bp, mus musculus
tacgcagcggctatgctcccctgag

SEQ ID NO: 127266 - DNA, 25 bp, mus musculus
gggtcagccttcaatcccaagcact

SEQ ID NO: 127267 - DNA, 25 bp, mus musculus
gtcagccttcaatcccaagcactcg

SEQ ID NO: 127268 - DNA, 25 bp, mus musculus
aatcggcgtggtgagaggcccttca

SEQ ID NO: 127269 - DNA, 25 bp, mus musculus
cttcacttgcatggagtgtggcaaa

SEQ ID NO: 127270 - DNA, 25 bp, mus musculus
tcacttgcatggagtgtggcaaaaa

SEQ ID NO: 127271 - DNA, 25 bp, mus musculus
agattaacctcatcatccaccagcg

SEQ ID NO: 127272 - DNA, 25 bp, mus musculus
ctacgagtgtgccgagtgtgagatc

SEQ ID NO: 127273 - DNA, 25 bp, mus musculus
acgagtgtgccgagtgtgagatcag

SEQ ID NO: 127274 - DNA, 25 bp, mus musculus
tgtgagatcagcttccgccacaagc

SEQ ID NO: 127275 - DNA, 25 bp, mus musculus
tgagatcagcttccgccacaagcag

SEQ ID NO: 127276 - DNA, 25 bp, mus musculus
tggccctcctttctcatgtagtaca

SEQ ID NO: 127277 - DNA, 25 bp, mus musculus
aagacatcactcatataatgtgtga

SEQ ID NO: 127278 - DNA, 25 bp, mus musculus
tccctgtgttctggcaaataattcc

SEQ ID NO: 127279 - DNA, 25 bp, mus musculus
agatccaatttcttcatcccctttg

SEQ ID NO: 127280 - DNA, 25 bp, mus musculus
attctttcttcctggcttacagtgt

SEQ ID NO: 127281 - DNA, 25 bp, mus musculus
tggcttacagtgttgagtggagact

SEQ ID NO: 127282 - DNA, 25 bp, mus musculus
atacagcatccccagtataaattct

SEQ ID NO: 127283 - DNA, 25 bp, mus musculus
catccccagtataaattctgtgatc

SEQ ID NO: 127284 - DNA, 25 bp, mus musculus
caattccagtctatccacatgttac

SEQ ID NO: 127285 - DNA, 25 bp, mus musculus
cagtctatccacatgttacctagga

SEQ ID NO: 127286 - DNA, 25 bp, mus musculus
atccacatgttacctaggatacctc

SEQ ID NO: 127287 - DNA, 25 bp, mus musculus
atatacccatgacaatttttcatga

SEQ ID NO: 127288 - DNA, 25 bp, mus musculus
ctttacctaacattcttcagagctt

SEQ ID NO: 127289 - DNA, 25 bp, mus musculus
ctaacattcttcagagcttcttata

SEQ ID NO: 127290 - DNA, 25 bp, mus musculus
ttcttcagagcttcttataacaaag

SEQ ID NO: 127291 - DNA, 25 bp, mus musculus
gtaaacaagcctcagatcttccatt

SEQ ID NO: 127292 - DNA, 25 bp, mus musculus
cagatcttccattacggtcatttat

SEQ ID NO: 127293 - DNA, 25 bp, mus musculus
ttccattacggtcatttattctgac

SEQ ID NO: 127294 - DNA, 25 bp, mus musculus
catttattctgactttcatccctgt

SEQ ID NO: 127295 - DNA, 25 bp, mus musculus
ctttcatccctgtgttctggcaaat

SEQ ID NO: 127296 - DNA, 25 bp, mus musculus
tttgtcttgcgaggaattgtgttat

SEQ ID NO: 127297 - DNA, 25 bp, mus musculus
ttgtcttgcgaggaattgtgttata

SEQ ID NO: 127298 - DNA, 25 bp, mus musculus
catgcagagtgtccttcagtagttg

SEQ ID NO: 127299 - DNA, 25 bp, mus musculus
atgcagagtgtccttcagtagttgc

SEQ ID NO: 127300 - DNA, 25 bp, mus musculus
cagtagttgcccttggtgctgcatt

SEQ ID NO: 127301 - DNA, 25 bp, mus musculus
agtagttgcccttggtgctgcattg

SEQ ID NO: 127302 - DNA, 25 bp, mus musculus
tagttgcccttggtgctgcattggt

SEQ ID NO: 127303 - DNA, 25 bp, mus musculus
agttgcccttggtgctgcattggta

SEQ ID NO: 127304 - DNA, 25 bp, mus musculus
gttgcccttggtgctgcattggtac

SEQ ID NO: 127305 - DNA, 25 bp, mus musculus
cccttggtgctgcattggtacgagg

SEQ ID NO: 127306 - DNA, 25 bp, mus musculus
cattggtacgaggttccttgagata

SEQ ID NO: 127307 - DNA, 25 bp, mus musculus
ttggtacgaggttccttgagataat

SEQ ID NO: 127308 - DNA, 25 bp, mus musculus
agatgtggttcgcatgcagagtgtc

SEQ ID NO: 127309 - DNA, 25 bp, mus musculus
gatgtggttcgcatgcagagtgtcc

SEQ ID NO: 127310 - DNA, 25 bp, mus musculus
tgtggttcgcatgcagagtgtcctt

SEQ ID NO: 127311 - DNA, 25 bp, mus musculus
gtggttcgcatgcagagtgtccttc

SEQ ID NO: 127312 - DNA, 25 bp, mus musculus
tggttcgcatgcagagtgtccttca

SEQ ID NO: 127313 - DNA, 25 bp, mus musculus
gttcgcatgcagagtgtccttcagt

SEQ ID NO: 127314 - DNA, 25 bp, mus musculus
ttcgcatgcagagtgtccttcagta

SEQ ID NO: 127315 - DNA, 25 bp, mus musculus
gcatgcagagtgtccttcagtagtt

SEQ ID NO: 127316 - DNA, 25 bp, mus musculus
tatcattgacttaaccaaaaccaat

SEQ ID NO: 127317 - DNA, 25 bp, mus musculus
ttgacttaaccaaaaccaatcgctg

SEQ ID NO: 127318 - DNA, 25 bp, mus musculus
cctctcttccgatcgatacagcatt

SEQ ID NO: 127319 - DNA, 25 bp, mus musculus
ttccgatcgatacagcattgggtga

SEQ ID NO: 127320 - DNA, 25 bp, mus musculus
tccgatcgatacagcattgggtgac

SEQ ID NO: 127321 - DNA, 25 bp, mus musculus
ccgatcgatacagcattgggtgaca

SEQ ID NO: 127322 - DNA, 25 bp, mus musculus
cgatcgatacagcattgggtgacaa

SEQ ID NO: 127323 - DNA, 25 bp, mus musculus
gatcgatacagcattgggtgacaag

SEQ ID NO: 127324 - DNA, 25 bp, mus musculus
tgacttaaccaaaaccaatcgctgc

SEQ ID NO: 127325 - DNA, 25 bp, mus musculus
ttaaccaaaaccaatcgctgcctca

SEQ ID NO: 127326 - DNA, 25 bp, mus musculus
taaccaaaaccaatcgctgcctcaa

SEQ ID NO: 127327 - DNA, 25 bp, mus musculus
aaccaaaaccaatcgctgcctcaag

SEQ ID NO: 127328 - DNA, 25 bp, mus musculus
accaaaaccaatcgctgcctcaagg

SEQ ID NO: 127329 - DNA, 25 bp, mus musculus
tccagcatcctctcttccgatcgat

SEQ ID NO: 127330 - DNA, 25 bp, mus musculus
catcctctcttccgatcgatacagc

SEQ ID NO: 127331 - DNA, 25 bp, mus musculus
atcctctcttccgatcgatacagca

SEQ ID NO: 127332 - DNA, 25 bp, mus musculus
cgccggacccctgatgatgttctta

SEQ ID NO: 127333 - DNA, 25 bp, mus musculus
cggacccctgatgatgttcttactg

SEQ ID NO: 127334 - DNA, 25 bp, mus musculus
atgtttcccaacacagtacctgaga

SEQ ID NO: 127335 - DNA, 25 bp, mus musculus
tttcccaacacagtacctgagagca

SEQ ID NO: 127336 - DNA, 25 bp, mus musculus
agggccgcgacagccactgtatcct

SEQ ID NO: 127337 - DNA, 25 bp, mus musculus
gcgacagccactgtatcctctcgag

SEQ ID NO: 127338 - DNA, 25 bp, mus musculus
acagccactgtatcctctcgagcgt

SEQ ID NO: 127339 - DNA, 25 bp, mus musculus
gtatcctctcgagcgtcaacagagg

SEQ ID NO: 127340 - DNA, 25 bp, mus musculus
tcctctcgagcgtcaacagaggagg

SEQ ID NO: 127341 - DNA, 25 bp, mus musculus
cctctcgagcgtcaacagaggaggc

SEQ ID NO: 127342 - DNA, 25 bp, mus musculus
ctctcgagcgtcaacagaggaggca

SEQ ID NO: 127343 - DNA, 25 bp, mus musculus
tctcgagcgtcaacagaggaggcac

SEQ ID NO: 127344 - DNA, 25 bp, mus musculus
acccctgatgatgttcttactgcta

SEQ ID NO: 127345 - DNA, 25 bp, mus musculus
gatgatgttcttactgctagccttg

SEQ ID NO: 127346 - DNA, 25 bp, mus musculus
gatgttcttactgctagccttgaga

SEQ ID NO: 127347 - DNA, 25 bp, mus musculus
gttcttactgctagccttgagagca

SEQ ID NO: 127348 - DNA, 25 bp, mus musculus
cttactgctagccttgagagcagca

SEQ ID NO: 127349 - DNA, 25 bp, mus musculus
agcagcaacatgtttcccaacacag

SEQ ID NO: 127350 - DNA, 25 bp, mus musculus
agcaacatgtttcccaacacagtac

SEQ ID NO: 127351 - DNA, 25 bp, mus musculus
aacatgtttcccaacacagtacctg

SEQ ID NO: 127352 - DNA, 25 bp, mus musculus
cggtctctccgcgaagcgaggacga

SEQ ID NO: 127353 - DNA, 25 bp, mus musculus
ggtctctccgcgaagcgaggacgat

SEQ ID NO: 127354 - DNA, 25 bp, mus musculus
ctttggaggtcatcctttgatggcg

SEQ ID NO: 127355 - DNA, 25 bp, mus musculus
tggaggtcatcctttgatggcgcaa

SEQ ID NO: 127356 - DNA, 25 bp, mus musculus
atcctttgatggcgcaagatatcta

SEQ ID NO: 127357 - DNA, 25 bp, mus musculus
tcctttgatggcgcaagatatctac

SEQ ID NO: 127358 - DNA, 25 bp, mus musculus
actctcacagcttagatgtcatcga

SEQ ID NO: 127359 - DNA, 25 bp, mus musculus
ctctcacagcttagatgtcatcgat

SEQ ID NO: 127360 - DNA, 25 bp, mus musculus
tctcacagcttagatgtcatcgatt

SEQ ID NO: 127361 - DNA, 25 bp, mus musculus
tcacagcttagatgtcatcgattca

SEQ ID NO: 127362 - DNA, 25 bp, mus musculus
tagatgtcatcgattcacgaggaga

SEQ ID NO: 127363 - DNA, 25 bp, mus musculus
atcgattcacgaggagaggattcta

SEQ ID NO: 127364 - DNA, 25 bp, mus musculus
acgatgacatctgagcacgtcccgc

SEQ ID NO: 127365 - DNA, 25 bp, mus musculus
cgatgacatctgagcacgtcccgcg

SEQ ID NO: 127366 - DNA, 25 bp, mus musculus
aagcaaggactggtctccgacaatg

SEQ ID NO: 127367 - DNA, 25 bp, mus musculus
agcaaggactggtctccgacaatgc

SEQ ID NO: 127368 - DNA, 25 bp, mus musculus
tggtctccgacaatgctttggaggt

SEQ ID NO: 127369 - DNA, 25 bp, mus musculus
ctccgacaatgctttggaggtcatc

SEQ ID NO: 127370 - DNA, 25 bp, mus musculus
atgctttggaggtcatcctttgatg

SEQ ID NO: 127371 - DNA, 25 bp, mus musculus
gctttggaggtcatcctttgatggc

SEQ ID NO: 127372 - DNA, 25 bp, mus musculus
cgttttagcagtcgcagactcgaaa

SEQ ID NO: 127373 - DNA, 25 bp, mus musculus
tttagcagtcgcagactcgaaatga

SEQ ID NO: 127374 - DNA, 25 bp, mus musculus
cctcaagagtcagctggcaggatct

SEQ ID NO: 127375 - DNA, 25 bp, mus musculus
tcagctggcaggatctcaaagattt

SEQ ID NO: 127376 - DNA, 25 bp, mus musculus
atttcatgagacaagctggggaagt

SEQ ID NO: 127377 - DNA, 25 bp, mus musculus
aagtaacctttgcggatgacatcga

SEQ ID NO: 127378 - DNA, 25 bp, mus musculus
taacctttgcggatgacatcgacct

SEQ ID NO: 127379 - DNA, 25 bp, mus musculus
cctttgcggatgacatcgacctaaa

SEQ ID NO: 127380 - DNA, 25 bp, mus musculus
agttgagtttgcctcttatggtgac

SEQ ID NO: 127381 - DNA, 25 bp, mus musculus
tgagtttgcctcttatggtgactta

SEQ ID NO: 127382 - DNA, 25 bp, mus musculus
gtttgcctcttatggtgacttaaag

SEQ ID NO: 127383 - DNA, 25 bp, mus musculus
tgcctcttatggtgacttaaagaat

SEQ ID NO: 127384 - DNA, 25 bp, mus musculus
agcagtcgcagactcgaaatgatag

SEQ ID NO: 127385 - DNA, 25 bp, mus musculus
atagacgaaatgctccacctgtaag

SEQ ID NO: 127386 - DNA, 25 bp, mus musculus
gacgaaatgctccacctgtaagaac

SEQ ID NO: 127387 - DNA, 25 bp, mus musculus
gaaatgctccacctgtaagaacaga

SEQ ID NO: 127388 - DNA, 25 bp, mus musculus
atgctccacctgtaagaacagaaaa

SEQ ID NO: 127389 - DNA, 25 bp, mus musculus
ctccacctgtaagaacagaaaatcg

SEQ ID NO: 127390 - DNA, 25 bp, mus musculus
atttatcctcaagagtcagctggca

SEQ ID NO: 127391 - DNA, 25 bp, mus musculus
tatcctcaagagtcagctggcagga

SEQ ID NO: 127392 - DNA, 25 bp, mus musculus
gagattcccaagatcaaagagattg

SEQ ID NO: 127393 - DNA, 25 bp, mus musculus
gctcaggttctgattcggttccatg

SEQ ID NO: 127394 - DNA, 25 bp, mus musculus
tactgaggtccacttgcttgatgag

SEQ ID NO: 127395 - DNA, 25 bp, mus musculus
ggtccacttgcttgatgagatccgt

SEQ ID NO: 127396 - DNA, 25 bp, mus musculus
cttgcttgatgagatccgtgcatga

SEQ ID NO: 127397 - DNA, 25 bp, mus musculus
atagattccttcgtctctctaaaat

SEQ ID NO: 127398 - DNA, 25 bp, mus musculus
gtctctctaaaatcaacctggatgt

SEQ ID NO: 127399 - DNA, 25 bp, mus musculus
taggctaccatctggcaatgcagga

SEQ ID NO: 127400 - DNA, 25 bp, mus musculus
accatctggcaatgcaggatttaaa

SEQ ID NO: 127401 - DNA, 25 bp, mus musculus
gcaacggttctcactagcgagggct

SEQ ID NO: 127402 - DNA, 25 bp, mus musculus
gttctcactagcgagggctgagcac

SEQ ID NO: 127403 - DNA, 25 bp, mus musculus
actagcgagggctgagcacatgttt

SEQ ID NO: 127404 - DNA, 25 bp, mus musculus
gttctgattcggttccatgtccaaa

SEQ ID NO: 127405 - DNA, 25 bp, mus musculus
attcggttccatgtccaaaggaatg

SEQ ID NO: 127406 - DNA, 25 bp, mus musculus
ttccatgtccaaaggaatgtggtgg

SEQ ID NO: 127407 - DNA, 25 bp, mus musculus
acaccctcacgcatacaggagaacc

SEQ ID NO: 127408 - DNA, 25 bp, mus musculus
gagaacctgcaggtcttcgacttcc

SEQ ID NO: 127409 - DNA, 25 bp, mus musculus
atggctgccattctcagcttcaaca

SEQ ID NO: 127410 - DNA, 25 bp, mus musculus
gccattctcagcttcaacaggaact

SEQ ID NO: 127411 - DNA, 25 bp, mus musculus
gaggactatcctttccacgaggaat

SEQ ID NO: 127412 - DNA, 25 bp, mus musculus
tggcctctacggtctcatcgtggcc

SEQ ID NO: 127413 - DNA, 25 bp, mus musculus
gtagtccttttccaccatcagtcac

SEQ ID NO: 127414 - DNA, 25 bp, mus musculus
gcccctgaccagtgacgaagtcagc

SEQ ID NO: 127415 - DNA, 25 bp, mus musculus
tgacgaagtcagcctctggttaccc

SEQ ID NO: 127416 - DNA, 25 bp, mus musculus
ctagagtgctcctgtgtataagaat

SEQ ID NO: 127417 - DNA, 25 bp, mus musculus
tgctcctgtgtataagaatgaacta

SEQ ID NO: 127418 - DNA, 25 bp, mus musculus
gatttgacctattcatgcgtctgtg

SEQ ID NO: 127419 - DNA, 25 bp, mus musculus
tagtagactgttgccttgtggggtt

SEQ ID NO: 127420 - DNA, 25 bp, mus musculus
gccttgtggggttcctgttgctgag

SEQ ID NO: 127421 - DNA, 25 bp, mus musculus
tagagtgctactgctcctcagagct

SEQ ID NO: 127422 - DNA, 25 bp, mus musculus
gctcctcagagctggctcccagctg

SEQ ID NO: 127423 - DNA, 25 bp, mus musculus
tggctcccagctgtgtccaataaaa

SEQ ID NO: 127424 - DNA, 25 bp, mus musculus
caccatcagtcacaggataggatgt

SEQ ID NO: 127425 - DNA, 25 bp, mus musculus
ctcctcattccagaacgaacagcct

SEQ ID NO: 127426 - DNA, 25 bp, mus musculus
attccagaacgaacagcctgacaca

SEQ ID NO: 127427 - DNA, 25 bp, mus musculus
gaacgaacagcctgacacatgcacg

SEQ ID NO: 127428 - DNA, 25 bp, mus musculus
tgacacatgcacgggcagctgcccc

SEQ ID NO: 127429 - DNA, 25 bp, mus musculus
ctgcccctcagtagttggtcttgta

SEQ ID NO: 127430 - DNA, 25 bp, mus musculus
gcagtgtcctagtgcccattgtctg

SEQ ID NO: 127431 - DNA, 25 bp, mus musculus
caccgtgctgtggacatacgggccc

SEQ ID NO: 127432 - DNA, 25 bp, mus musculus
tttacaagagcttcaggcctcaatg

SEQ ID NO: 127433 - DNA, 25 bp, mus musculus
gcttcaggcctcaatggagcagctg

SEQ ID NO: 127434 - DNA, 25 bp, mus musculus
gagcaccagcatctctatgccaaga

SEQ ID NO: 127435 - DNA, 25 bp, mus musculus
caccagcatctctatgccaagattc

SEQ ID NO: 127436 - DNA, 25 bp, mus musculus
ctctatgccaagattctgcatttag

SEQ ID NO: 127437 - DNA, 25 bp, mus musculus
tatgccaagattctgcatttagtca

SEQ ID NO: 127438 - DNA, 25 bp, mus musculus
ctgcatttagtcatggcagatggag

SEQ ID NO: 127439 - DNA, 25 bp, mus musculus
ttagtcatggcagatggagcctatc

SEQ ID NO: 127440 - DNA, 25 bp, mus musculus
taatcctcaggacattctttaatag

SEQ ID NO: 127441 - DNA, 25 bp, mus musculus
cattctttaatagtcaactgtaaga

SEQ ID NO: 127442 - DNA, 25 bp, mus musculus
aacacatttgaacttggctcataat

SEQ ID NO: 127443 - DNA, 25 bp, mus musculus
tttgaacttggctcataatacaagc

SEQ ID NO: 127444 - DNA, 25 bp, mus musculus
tcaggcctcaatggagcagctgctt

SEQ ID NO: 127445 - DNA, 25 bp, mus musculus
cataatacaagcttcctgggaaata

SEQ ID NO: 127446 - DNA, 25 bp, mus musculus
aatggagcagctgcttagggagcaa

SEQ ID NO: 127447 - DNA, 25 bp, mus musculus
gacagatgccccagacgaggaggac

SEQ ID NO: 127448 - DNA, 25 bp, mus musculus
agtgacgctgagaccactagtgaat

SEQ ID NO: 127449 - DNA, 25 bp, mus musculus
gacgctgagaccactagtgaatgtg

SEQ ID NO: 127450 - DNA, 25 bp, mus musculus
ctaagacttcacttggagcaagaaa

SEQ ID NO: 127451 - DNA, 25 bp, mus musculus
agacttcacttggagcaagaaatgg

SEQ ID NO: 127452 - DNA, 25 bp, mus musculus
aatgagcaccagcatctctatgcca

SEQ ID NO: 127453 - DNA, 25 bp, mus musculus
ggccaagccggttgtgagtgacgat

SEQ ID NO: 127454 - DNA, 25 bp, mus musculus
aaccagacattcctgagtcctgacc

SEQ ID NO: 127455 - DNA, 25 bp, mus musculus
ggccccagtcactgtagctcagtgg

SEQ ID NO: 127456 - DNA, 25 bp, mus musculus
cactgtagctcagtggatgcatgcg

SEQ ID NO: 127457 - DNA, 25 bp, mus musculus
cggccgctccttgtactgtatctta

SEQ ID NO: 127458 - DNA, 25 bp, mus musculus
ctccttgtactgtatcttactggac

SEQ ID NO: 127459 - DNA, 25 bp, mus musculus
cttgtactgtatcttactggacagg

SEQ ID NO: 127460 - DNA, 25 bp, mus musculus
gtactgtatcttactggacagggcc

SEQ ID NO: 127461 - DNA, 25 bp, mus musculus
tatcttactggacagggccagctct

SEQ ID NO: 127462 - DNA, 25 bp, mus musculus
cttactggacagggccagctctcca

SEQ ID NO: 127463 - DNA, 25 bp, mus musculus
atgtcagtgtcactggagtcagaca

SEQ ID NO: 127464 - DNA, 25 bp, mus musculus
tcagtgtcactggagtcagacagta

SEQ ID NO: 127465 - DNA, 25 bp, mus musculus
cagacattcctgagtcctgaccccg

SEQ ID NO: 127466 - DNA, 25 bp, mus musculus
gagtagcccttagcagtgatgggta

SEQ ID NO: 127467 - DNA, 25 bp, mus musculus
tacacatgcaatcttccacattttt

SEQ ID NO: 127468 - DNA, 25 bp, mus musculus
acatgcaatcttccacatttttagg

SEQ ID NO: 127469 - DNA, 25 bp, mus musculus
cttccacatttttaggcagagaagt

SEQ ID NO: 127470 - DNA, 25 bp, mus musculus
aagtataggcctgtctgtcggccct

SEQ ID NO: 127471 - DNA, 25 bp, mus musculus
ggcctcgagtctctaccagcattaa

SEQ ID NO: 127472 - DNA, 25 bp, mus musculus
tctctaccagcattaactgtctaga

SEQ ID NO: 127473 - DNA, 25 bp, mus musculus
ccttggccctgaacagacacacaca

SEQ ID NO: 127474 - DNA, 25 bp, mus musculus
tggccctgaacagacacacacacac

SEQ ID NO: 127475 - DNA, 25 bp, mus musculus
tagggcatagctcacctttgaaccg

SEQ ID NO: 127476 - DNA, 25 bp, mus musculus
atagctcacctttgaaccgggccat

SEQ ID NO: 127477 - DNA, 25 bp, mus musculus
gctcacctttgaaccgggccatcaa

SEQ ID NO: 127478 - DNA, 25 bp, mus musculus
cacctttgaaccgggccatcaattg

SEQ ID NO: 127479 - DNA, 25 bp, mus musculus
ctttgaaccgggccatcaattgcct

SEQ ID NO: 127480 - DNA, 25 bp, mus musculus
gggccatcaattgcctgaatatata

SEQ ID NO: 127481 - DNA, 25 bp, mus musculus
tcttcttcagctcatgagctggtgt

SEQ ID NO: 127482 - DNA, 25 bp, mus musculus
agcttgctgtgtttcccagcctctg

SEQ ID NO: 127483 - DNA, 25 bp, mus musculus
ttgctgtgtttcccagcctctgcca

SEQ ID NO: 127484 - DNA, 25 bp, mus musculus
ccctgcaccatgttcttgagataaa

SEQ ID NO: 127485 - DNA, 25 bp, mus musculus
ctcatggattgccaacctgaattcc

SEQ ID NO: 127486 - DNA, 25 bp, mus musculus
cacacataccctggacttgcacaag

SEQ ID NO: 127487 - DNA, 25 bp, mus musculus
acataccctggacttgcacaagggc

SEQ ID NO: 127488 - DNA, 25 bp, mus musculus
taccctggacttgcacaagggccaa

SEQ ID NO: 127489 - DNA, 25 bp, mus musculus
cttgcacaagggccaaagatctgag

SEQ ID NO: 127490 - DNA, 25 bp, mus musculus
atctgagcagcatacttcatgtagg

SEQ ID NO: 127491 - DNA, 25 bp, mus musculus
tgagcagcatacttcatgtagggca

SEQ ID NO: 127492 - DNA, 25 bp, mus musculus
gcagcatacttcatgtagggcatag

SEQ ID NO: 127493 - DNA, 25 bp, mus musculus
caggaactggacccagcctggctga

SEQ ID NO: 127494 - DNA, 25 bp, mus musculus
gaactggacccagcctggctgattg

SEQ ID NO: 127495 - DNA, 25 bp, mus musculus
tcaggcatgaactgcctcagtggcc

SEQ ID NO: 127496 - DNA, 25 bp, mus musculus
atgaactgcctcagtggccacaatt

SEQ ID NO: 127497 - DNA, 25 bp, mus musculus
aactgcctcagtggccacaattatg

SEQ ID NO: 127498 - DNA, 25 bp, mus musculus
tgcctcagtggccacaattatgtcc

SEQ ID NO: 127499 - DNA, 25 bp, mus musculus
agtggccacaattatgtccatagag

SEQ ID NO: 127500 - DNA, 25 bp, mus musculus
ggccacaattatgtccatagagacc

SEQ ID NO: 127501 - DNA, 25 bp, mus musculus
atccgatggacggccccaggagcta

SEQ ID NO: 127502 - DNA, 25 bp, mus musculus
acggccccaggagctattgcccatc

SEQ ID NO: 127503 - DNA, 25 bp, mus musculus
cggatcttcaccacagccagtgatg

SEQ ID NO: 127504 - DNA, 25 bp, mus musculus
atcttcaccacagccagtgatgtgt

SEQ ID NO: 127505 - DNA, 25 bp, mus musculus
ctggacccagcctggctgattgtgg

SEQ ID NO: 127506 - DNA, 25 bp, mus musculus
ccagcctggctgattgtggacactg

SEQ ID NO: 127507 - DNA, 25 bp, mus musculus
attgtggacactgtcataggagaag

SEQ ID NO: 127508 - DNA, 25 bp, mus musculus
ttgagagatacatccccagatggct

SEQ ID NO: 127509 - DNA, 25 bp, mus musculus
agagatacatccccagatggctact

SEQ ID NO: 127510 - DNA, 25 bp, mus musculus
tccccagatggctactggtggaatt

SEQ ID NO: 127511 - DNA, 25 bp, mus musculus
aatttccttcgagaggcaactatca

SEQ ID NO: 127512 - DNA, 25 bp, mus musculus
ttccttcgagaggcaactatcatgg

SEQ ID NO: 127513 - DNA, 25 bp, mus musculus
ctcgcacaggctgataaccccttac

SEQ ID NO: 127514 - DNA, 25 bp, mus musculus
cctcacttctgacaatgcaaaaatg

SEQ ID NO: 127515 - DNA, 25 bp, mus musculus
gtgagacaccagcactgagccccct

SEQ ID NO: 127516 - DNA, 25 bp, mus musculus
tcccttctgcaataattcaggggct

SEQ ID NO: 127517 - DNA, 25 bp, mus musculus
agtactatgtagccgagctgccctt

SEQ ID NO: 127518 - DNA, 25 bp, mus musculus
tgcccttccttcctatggaagtggg

SEQ ID NO: 127519 - DNA, 25 bp, mus musculus
tccttcctatggaagtgggaaacat

SEQ ID NO: 127520 - DNA, 25 bp, mus musculus
acccagtgtctgggcttaggatcct

SEQ ID NO: 127521 - DNA, 25 bp, mus musculus
cagtgtctgggcttaggatcctcag

SEQ ID NO: 127522 - DNA, 25 bp, mus musculus
ttaggatcctcaggcaaggccctgg

SEQ ID NO: 127523 - DNA, 25 bp, mus musculus
tcccatcctgagtctggaatcactt

SEQ ID NO: 127524 - DNA, 25 bp, mus musculus
cctgagtctggaatcacttgtgatg

SEQ ID NO: 127525 - DNA, 25 bp, mus musculus
cacttctgacaatgcaaaaatggtc

SEQ ID NO: 127526 - DNA, 25 bp, mus musculus
aatggtcttcaaagcacatgcaaag

SEQ ID NO: 127527 - DNA, 25 bp, mus musculus
ggtcttcaaagcacatgcaaagctc

SEQ ID NO: 127528 - DNA, 25 bp, mus musculus
agcacatgcaaagctccccgggtga

SEQ ID NO: 127529 - DNA, 25 bp, mus musculus
acatgcaaagctccccgggtgagag

SEQ ID NO: 127530 - DNA, 25 bp, mus musculus
tgcaaagctccccgggtgagagagc

SEQ ID NO: 127531 - DNA, 25 bp, mus musculus
gctccccgggtgagagagccatcct

SEQ ID NO: 127532 - DNA, 25 bp, mus musculus
caccccgtgagacaccagcactgag

SEQ ID NO: 127533 - DNA, 25 bp, mus musculus
ctccctgtatcccaggcttggatcc

SEQ ID NO: 127534 - DNA, 25 bp, mus musculus
ctgtatcccaggcttggatcctgtg

SEQ ID NO: 127535 - DNA, 25 bp, mus musculus
ccactaacatctccttttggctcag

SEQ ID NO: 127536 - DNA, 25 bp, mus musculus
actaacatctccttttggctcagca

SEQ ID NO: 127537 - DNA, 25 bp, mus musculus
taacatctccttttggctcagcatt

SEQ ID NO: 127538 - DNA, 25 bp, mus musculus
acatctccttttggctcagcattca

SEQ ID NO: 127539 - DNA, 25 bp, mus musculus
ctcagcattcaccgatctttaggga

SEQ ID NO: 127540 - DNA, 25 bp, mus musculus
cagcattcaccgatctttagggaaa

SEQ ID NO: 127541 - DNA, 25 bp, mus musculus
attcaccgatctttagggaaatgct

SEQ ID NO: 127542 - DNA, 25 bp, mus musculus
tcaccgatctttagggaaatgctgt

SEQ ID NO: 127543 - DNA, 25 bp, mus musculus
aacgcattcatttctctatgcaaaa

SEQ ID NO: 127544 - DNA, 25 bp, mus musculus
cgcattcatttctctatgcaaaaaa

SEQ ID NO: 127545 - DNA, 25 bp, mus musculus
gtatcccaggcttggatcctgtgga

SEQ ID NO: 127546 - DNA, 25 bp, mus musculus
atcccaggcttggatcctgtggacc

SEQ ID NO: 127547 - DNA, 25 bp, mus musculus
cccaggcttggatcctgtggaccag

SEQ ID NO: 127548 - DNA, 25 bp, mus musculus
ggcttggatcctgtggaccagggtt

SEQ ID NO: 127549 - DNA, 25 bp, mus musculus
tggatcctgtggaccagggttactg

SEQ ID NO: 127550 - DNA, 25 bp, mus musculus
gatcctgtggaccagggttactgtt

SEQ ID NO: 127551 - DNA, 25 bp, mus musculus
tactgttttaccactaacatctcct

SEQ ID NO: 127552 - DNA, 25 bp, mus musculus
taccactaacatctccttttggctc

SEQ ID NO: 127553 - DNA, 25 bp, mus musculus
cccgactccgatgttgagggctacg

SEQ ID NO: 127554 - DNA, 25 bp, mus musculus
ccgactccgatgttgagggctacgt

SEQ ID NO: 127555 - DNA, 25 bp, mus musculus
aaattcctattgtgatttgactgtt

SEQ ID NO: 127556 - DNA, 25 bp, mus musculus
gactccgatgttgagggctacgtgg

SEQ ID NO: 127557 - DNA, 25 bp, mus musculus
actccgatgttgagggctacgtgga

SEQ ID NO: 127558 - DNA, 25 bp, mus musculus
ctccgatgttgagggctacgtggag

SEQ ID NO: 127559 - DNA, 25 bp, mus musculus
tgatgaatatgcccagctagtggaa

SEQ ID NO: 127560 - DNA, 25 bp, mus musculus
gatgaatatgcccagctagtggaag

SEQ ID NO: 127561 - DNA, 25 bp, mus musculus
atgaatatgcccagctagtggaaga

SEQ ID NO: 127562 - DNA, 25 bp, mus musculus
tgaatatgcccagctagtggaagat

SEQ ID NO: 127563 - DNA, 25 bp, mus musculus
gaaattcctattgtgatttgactgt

SEQ ID NO: 127564 - DNA, 25 bp, mus musculus
gcccccgactccgatgttgagggct

SEQ ID NO: 127565 - DNA, 25 bp, mus musculus
cccgactccgatgttgagggctacg

SEQ ID NO: 127566 - DNA, 25 bp, mus musculus
gatgaatatgcccagctagtggaag

SEQ ID NO: 127567 - DNA, 25 bp, mus musculus
atgaatatgcccagctagtggaaga

SEQ ID NO: 127568 - DNA, 25 bp, mus musculus
tgaatatgcccagctagtggaagat

SEQ ID NO: 127569 - DNA, 25 bp, mus musculus
gaaccggacgatgagggcgaagagg

SEQ ID NO: 127570 - DNA, 25 bp, mus musculus
gaaattcctattgtgatttgactgt

SEQ ID NO: 127571 - DNA, 25 bp, mus musculus
aaattcctattgtgatttgactgtt

SEQ ID NO: 127572 - DNA, 25 bp, mus musculus
attcctattgtgatttgactgtttt

SEQ ID NO: 127573 - DNA, 25 bp, mus musculus
ttcctattgtgatttgactgttttt

SEQ ID NO: 127574 - DNA, 25 bp, mus musculus
ccgactccgatgttgagggctacgt

SEQ ID NO: 127575 - DNA, 25 bp, mus musculus
gactccgatgttgagggctacgtgg

SEQ ID NO: 127576 - DNA, 25 bp, mus musculus
actccgatgttgagggctacgtgga

SEQ ID NO: 127577 - DNA, 25 bp, mus musculus
ctccgatgttgagggctacgtggag

SEQ ID NO: 127578 - DNA, 25 bp, mus musculus
ccgatgttgagggctacgtggagga

SEQ ID NO: 127579 - DNA, 25 bp, mus musculus
cgatgttgagggctacgtggaggat

SEQ ID NO: 127580 - DNA, 25 bp, mus musculus
tgagggctacgtggaggatgacgac

SEQ ID NO: 127581 - DNA, 25 bp, mus musculus
tgatgaatatgcccagctagtggaa

SEQ ID NO: 127582 - DNA, 25 bp, mus musculus
ctgccatccatgctccacatggaga

SEQ ID NO: 127583 - DNA, 25 bp, mus musculus
gagagtcatgcttgtccctctacga

SEQ ID NO: 127584 - DNA, 25 bp, mus musculus
ctgtctatgcagcggccccaaagcc

SEQ ID NO: 127585 - DNA, 25 bp, mus musculus
cagcggccccaaagcctgcactttg

SEQ ID NO: 127586 - DNA, 25 bp, mus musculus
ttctttggtgctgtggcctgtgtgt

SEQ ID NO: 127587 - DNA, 25 bp, mus musculus
tgagtctgctccacctgtgtgtcca

SEQ ID NO: 127588 - DNA, 25 bp, mus musculus
tgctccacctgtgtgtccatatggg

SEQ ID NO: 127589 - DNA, 25 bp, mus musculus
acctgtgtgtccatatgggatctgt

SEQ ID NO: 127590 - DNA, 25 bp, mus musculus
tccatatgggatctgtctgtccatc

SEQ ID NO: 127591 - DNA, 25 bp, mus musculus
ccctgtgttggtgctgtgtcctcag

SEQ ID NO: 127592 - DNA, 25 bp, mus musculus
tgtgttggtgctgtgtcctcagctt

SEQ ID NO: 127593 - DNA, 25 bp, mus musculus
ggactccactgcagctccacaaata

SEQ ID NO: 127594 - DNA, 25 bp, mus musculus
gcttgtccctctacgattcatgtgt

SEQ ID NO: 127595 - DNA, 25 bp, mus musculus
tgtccctctacgattcatgtgtccc

SEQ ID NO: 127596 - DNA, 25 bp, mus musculus
gctggctggctagctggggacatct

SEQ ID NO: 127597 - DNA, 25 bp, mus musculus
ccccatgtgacccttgctctgtcta

SEQ ID NO: 127598 - DNA, 25 bp, mus musculus
catgtgacccttgctctgtctatgc

SEQ ID NO: 127599 - DNA, 25 bp, mus musculus
gtgacccttgctctgtctatgcagc

SEQ ID NO: 127600 - DNA, 25 bp, mus musculus
cttgctctgtctatgcagcggcccc

SEQ ID NO: 127601 - DNA, 25 bp, mus musculus
gctctgtctatgcagcggccccaaa

SEQ ID NO: 127602 - DNA, 25 bp, mus musculus
aaccccagactatgcacatgctaag

SEQ ID NO: 127603 - DNA, 25 bp, mus musculus
agactatgcacatgctaaggatgta

SEQ ID NO: 127604 - DNA, 25 bp, mus musculus
gtttgtgccgcagttggagccagca

SEQ ID NO: 127605 - DNA, 25 bp, mus musculus
ttcactctgacttgggactgagaat

SEQ ID NO: 127606 - DNA, 25 bp, mus musculus
tgagaatgcatttcctggtggagac

SEQ ID NO: 127607 - DNA, 25 bp, mus musculus
tggagacactcgggtgcagaaatat

SEQ ID NO: 127608 - DNA, 25 bp, mus musculus
acatacatgctgaagctgaggacta

SEQ ID NO: 127609 - DNA, 25 bp, mus musculus
ttttcagccttgggtatcctctctg

SEQ ID NO: 127610 - DNA, 25 bp, mus musculus
tctagccagtgtctggtacacactt

SEQ ID NO: 127611 - DNA, 25 bp, mus musculus
ctggtacacacttcttggcatggac

SEQ ID NO: 127612 - DNA, 25 bp, mus musculus
tcttggcatggacacctaggtcgac

SEQ ID NO: 127613 - DNA, 25 bp, mus musculus
catggacacctaggtcgacgcgggc

SEQ ID NO: 127614 - DNA, 25 bp, mus musculus
tttagccagcctctagtagactgta

SEQ ID NO: 127615 - DNA, 25 bp, mus musculus
cagcctctagtagactgtagtgtca

SEQ ID NO: 127616 - DNA, 25 bp, mus musculus
tatgtttgtgctgtatttggcagcc

SEQ ID NO: 127617 - DNA, 25 bp, mus musculus
ggcagcccctggggcacatagaagg

SEQ ID NO: 127618 - DNA, 25 bp, mus musculus
atcagatgacttctgtgaagctgcc

SEQ ID NO: 127619 - DNA, 25 bp, mus musculus
tgacttctgtgaagctgcctatgtt

SEQ ID NO: 127620 - DNA, 25 bp, mus musculus
agctgcctatgttgagtgtgttgaa

SEQ ID NO: 127621 - DNA, 25 bp, mus musculus
tccaggcctggggtttgtgccgcag

SEQ ID NO: 127622 - DNA, 25 bp, mus musculus
gaggtctttgctaatcttggtgctt

SEQ ID NO: 127623 - DNA, 25 bp, mus musculus
aatcttggtgctttgcttcctgccc

SEQ ID NO: 127624 - DNA, 25 bp, mus musculus
gaacctgtgcaacatcccgtgctca

SEQ ID NO: 127625 - DNA, 25 bp, mus musculus
gtgcaacatcccgtgctcagccctg

SEQ ID NO: 127626 - DNA, 25 bp, mus musculus
agccctgctgagctcagacataaca

SEQ ID NO: 127627 - DNA, 25 bp, mus musculus
ctcagacataacagcgagcgtgaac

SEQ ID NO: 127628 - DNA, 25 bp, mus musculus
cataacagcgagcgtgaactgcgcg

SEQ ID NO: 127629 - DNA, 25 bp, mus musculus
gcgcaaccgctgcaagggtaccgac

SEQ ID NO: 127630 - DNA, 25 bp, mus musculus
ccgctgcaagggtaccgacgtccag

SEQ ID NO: 127631 - DNA, 25 bp, mus musculus
taccgacgtccaggcgtggatcaga

SEQ ID NO: 127632 - DNA, 25 bp, mus musculus
cgtccaggcgtggatcagaggctgc

SEQ ID NO: 127633 - DNA, 25 bp, mus musculus
catccctcattaaaacgactatacg

SEQ ID NO: 127634 - DNA, 25 bp, mus musculus
atgtgagctggcagcggctatgaag

SEQ ID NO: 127635 - DNA, 25 bp, mus musculus
tatgaagcgtcacggacttgataac

SEQ ID NO: 127636 - DNA, 25 bp, mus musculus
gagtaacttcaacacccaggctaca

SEQ ID NO: 127637 - DNA, 25 bp, mus musculus
cgactacggaatcctacagatcaac

SEQ ID NO: 127638 - DNA, 25 bp, mus musculus
cggaatcctacagatcaacagccgc

SEQ ID NO: 127639 - DNA, 25 bp, mus musculus
caggaccccaggctccaggaacctg

SEQ ID NO: 127640 - DNA, 25 bp, mus musculus
cccaggctccaggaacctgtgcaac

SEQ ID NO: 127641 - DNA, 25 bp, mus musculus
ctccaggaacctgtgcaacatcccg

SEQ ID NO: 127642 - DNA, 25 bp, mus musculus
tgcaccaactgtatccatcttccca

SEQ ID NO: 127643 - DNA, 25 bp, mus musculus
aactgtatccatcttcccaccatcc

SEQ ID NO: 127644 - DNA, 25 bp, mus musculus
ggccactcacaagacatcaacttca

SEQ ID NO: 127645 - DNA, 25 bp, mus musculus
tcacaagacatcaacttcacccatt

SEQ ID NO: 127646 - DNA, 25 bp, mus musculus
gacatcaacttcacccattgtcaag

SEQ ID NO: 127647 - DNA, 25 bp, mus musculus
aacttcacccattgtcaagagcttc

SEQ ID NO: 127648 - DNA, 25 bp, mus musculus
acccattgtcaagagcttcaacagg

SEQ ID NO: 127649 - DNA, 25 bp, mus musculus
aaggtcctgagacgccaccaccagc

SEQ ID NO: 127650 - DNA, 25 bp, mus musculus
agctccatcctatcttcccttctaa

SEQ ID NO: 127651 - DNA, 25 bp, mus musculus
cacaagcgacctaccactgttgcgg

SEQ ID NO: 127652 - DNA, 25 bp, mus musculus
tttccttggcttttatcatgctaat

SEQ ID NO: 127653 - DNA, 25 bp, mus musculus
ttatcatgctaatatttgcagaaaa

SEQ ID NO: 127654 - DNA, 25 bp, mus musculus
cttcccaccatccagtgagcagtta

SEQ ID NO: 127655 - DNA, 25 bp, mus musculus
tggcgtcctgaacagttggactgat

SEQ ID NO: 127656 - DNA, 25 bp, mus musculus
cagcaaagacagcacctacagcatg

SEQ ID NO: 127657 - DNA, 25 bp, mus musculus
cacctacagcatgagcagcaccctc

SEQ ID NO: 127658 - DNA, 25 bp, mus musculus
cagcatgagcagcaccctcacgttg

SEQ ID NO: 127659 - DNA, 25 bp, mus musculus
acgacataacagctatacctgtgag

SEQ ID NO: 127660 - DNA, 25 bp, mus musculus
taacagctatacctgtgaggccact

SEQ ID NO: 127661 - DNA, 25 bp, mus musculus
ctgtgaggccactcacaagacatca

SEQ ID NO: 127662 - DNA, 25 bp, mus musculus
aacgacaaaatggcgtcctgaacag

SEQ ID NO: 127663 - DNA, 25 bp, mus musculus
acgacaaaatggcgtcctgaacagt

SEQ ID NO: 127664 - DNA, 25 bp, mus musculus
aaatggcgtcctgaacagttggact

SEQ ID NO: 127665 - DNA, 25 bp, mus musculus
aatggcgtcctgaacagttggactg

SEQ ID NO: 127666 - DNA, 25 bp, mus musculus
atggcgtcctgaacagttggactga

SEQ ID NO: 127667 - DNA, 25 bp, mus musculus
tggcgtcctgaacagttggactgat

SEQ ID NO: 127668 - DNA, 25 bp, mus musculus
gcgtcctgaacagttggactgatca

SEQ ID NO: 127669 - DNA, 25 bp, mus musculus
cgtcctgaacagttggactgatcag

SEQ ID NO: 127670 - DNA, 25 bp, mus musculus
agacatcaacttcacccattgtcaa

SEQ ID NO: 127671 - DNA, 25 bp, mus musculus
aacgacaaaatggcgtcctgaacag

SEQ ID NO: 127672 - DNA, 25 bp, mus musculus
acgacaaaatggcgtcctgaacagt

SEQ ID NO: 127673 - DNA, 25 bp, mus musculus
agacatcaacttcacccattgtcaa

SEQ ID NO: 127674 - DNA, 25 bp, mus musculus
caaaggtcctgagacgccaccacca

SEQ ID NO: 127675 - DNA, 25 bp, mus musculus
aaaggtcctgagacgccaccaccag

SEQ ID NO: 127676 - DNA, 25 bp, mus musculus
aaggtcctgagacgccaccaccagc

SEQ ID NO: 127677 - DNA, 25 bp, mus musculus
caaaatggcgtcctgaacagttgga

SEQ ID NO: 127678 - DNA, 25 bp, mus musculus
aaatggcgtcctgaacagttggact

SEQ ID NO: 127679 - DNA, 25 bp, mus musculus
aatggcgtcctgaacagttggactg

SEQ ID NO: 127680 - DNA, 25 bp, mus musculus
atggcgtcctgaacagttggactga

SEQ ID NO: 127681 - DNA, 25 bp, mus musculus
tggcgtcctgaacagttggactgat

SEQ ID NO: 127682 - DNA, 25 bp, mus musculus
gcgtcctgaacagttggactgatca

SEQ ID NO: 127683 - DNA, 25 bp, mus musculus
cgtcctgaacagttggactgatcag

SEQ ID NO: 127684 - DNA, 25 bp, mus musculus
gtcctgaacagttggactgatcagg

SEQ ID NO: 127685 - DNA, 25 bp, mus musculus
gactcacagggatctgccttcacca

SEQ ID NO: 127686 - DNA, 25 bp, mus musculus
cagggatctgccttcaccacagaag

SEQ ID NO: 127687 - DNA, 25 bp, mus musculus
cctgactgtgacagaggaggaatgg

SEQ ID NO: 127688 - DNA, 25 bp, mus musculus
actgtacaatgtctccctgatcatg

SEQ ID NO: 127689 - DNA, 25 bp, mus musculus
caatgtctccctgatcatgtctgac

SEQ ID NO: 127690 - DNA, 25 bp, mus musculus
ctccctgatcatgtctgacacaggc

SEQ ID NO: 127691 - DNA, 25 bp, mus musculus
gtctgacacaggcgggacctgctat

SEQ ID NO: 127692 - DNA, 25 bp, mus musculus
cacaggcgggacctgctattgacca

SEQ ID NO: 127693 - DNA, 25 bp, mus musculus
cgggacctgctattgaccatgctag

SEQ ID NO: 127694 - DNA, 25 bp, mus musculus
ctgctattgaccatgctagcgctca

SEQ ID NO: 127695 - DNA, 25 bp, mus musculus
atgctagcgctcaaccaggcaggcc

SEQ ID NO: 127696 - DNA, 25 bp, mus musculus
atgcaaactaaccatgtcagagtga

SEQ ID NO: 127697 - DNA, 25 bp, mus musculus
ttcaccacagaagaaattcatctca

SEQ ID NO: 127698 - DNA, 25 bp, mus musculus
caaacatccacctgctgtgtacctg

SEQ ID NO: 127699 - DNA, 25 bp, mus musculus
tccacctgctgtgtacctgctgcca

SEQ ID NO: 127700 - DNA, 25 bp, mus musculus
accagctcgtgagcaactgaacctg

SEQ ID NO: 127701 - DNA, 25 bp, mus musculus
gcaactgaacctgagggagtcagcc

SEQ ID NO: 127702 - DNA, 25 bp, mus musculus
cacagtcacctgcctggtgaagggc

SEQ ID NO: 127703 - DNA, 25 bp, mus musculus
tcctgcagacatcagtgtgcagtgg

SEQ ID NO: 127704 - DNA, 25 bp, mus musculus
cagcatcctgactgtgacagaggag

SEQ ID NO: 127705 - DNA, 25 bp, mus musculus
tgggcgtccacccggaaggacagca

SEQ ID NO: 127706 - DNA, 25 bp, mus musculus
gggcgtccacccggaaggacagcag

SEQ ID NO: 127707 - DNA, 25 bp, mus musculus
tctcggaatgcatgttgttcagggt

SEQ ID NO: 127708 - DNA, 25 bp, mus musculus
tcggaatgcatgttgttcagggtcc

SEQ ID NO: 127709 - DNA, 25 bp, mus musculus
ggaatgcatgttgttcagggtccgc

SEQ ID NO: 127710 - DNA, 25 bp, mus musculus
gaatgcatgttgttcagggtccgca

SEQ ID NO: 127711 - DNA, 25 bp, mus musculus
atgcatgttgttcagggtccgcagg

SEQ ID NO: 127712 - DNA, 25 bp, mus musculus
gcatgttgttcagggtccgcaggtc

SEQ ID NO: 127713 - DNA, 25 bp, mus musculus
catgttgttcagggtccgcaggtcc

SEQ ID NO: 127714 - DNA, 25 bp, mus musculus
tgttgttcagggtccgcaggtccgg

SEQ ID NO: 127715 - DNA, 25 bp, mus musculus
ttgttcagggtccgcaggtccggca

SEQ ID NO: 127716 - DNA, 25 bp, mus musculus
tgttcagggtccgcaggtccggcag

SEQ ID NO: 127717 - DNA, 25 bp, mus musculus
gcgtccacccggaaggacagcagct

SEQ ID NO: 127718 - DNA, 25 bp, mus musculus
gtccacccggaaggacagcagcttc

SEQ ID NO: 127719 - DNA, 25 bp, mus musculus
tccacccggaaggacagcagcttct

SEQ ID NO: 127720 - DNA, 25 bp, mus musculus
ccacccggaaggacagcagcttctc

SEQ ID NO: 127721 - DNA, 25 bp, mus musculus
ggacagcagcttctcggaatgcatg

SEQ ID NO: 127722 - DNA, 25 bp, mus musculus
gcttctcggaatgcatgttgttcag

SEQ ID NO: 127723 - DNA, 25 bp, mus musculus
cttctcggaatgcatgttgttcagg

SEQ ID NO: 127724 - DNA, 25 bp, mus musculus
ttctcggaatgcatgttgttcaggg

SEQ ID NO: 127725 - DNA, 25 bp, mus musculus
ataaggctctgggtacgaccagcca

SEQ ID NO: 127726 - DNA, 25 bp, mus musculus
aggctctgggtacgaccagccagca

SEQ ID NO: 127727 - DNA, 25 bp, mus musculus
gccgtctgcccagagagctgtgacc

SEQ ID NO: 127728 - DNA, 25 bp, mus musculus
gtctgcccagagagctgtgaccacc

SEQ ID NO: 127729 - DNA, 25 bp, mus musculus
tgcccagagagctgtgaccaccatt

SEQ ID NO: 127730 - DNA, 25 bp, mus musculus
gagagctgtgaccaccattgccact

SEQ ID NO: 127731 - DNA, 25 bp, mus musculus
tgtgaccaccattgccactactatc

SEQ ID NO: 127732 - DNA, 25 bp, mus musculus
gaccaccattgccactactatctac

SEQ ID NO: 127733 - DNA, 25 bp, mus musculus
caccattgccactactatctactca

SEQ ID NO: 127734 - DNA, 25 bp, mus musculus
cagctcccagcatgaaggtactgca

SEQ ID NO: 127735 - DNA, 25 bp, mus musculus
aggtactgcagtccatctctgcctc

SEQ ID NO: 127736 - DNA, 25 bp, mus musculus
tactgcagtccatctctgcctctag

SEQ ID NO: 127737 - DNA, 25 bp, mus musculus
ctctgggtacgaccagccagcatgg

SEQ ID NO: 127738 - DNA, 25 bp, mus musculus
actgcagtccatctctgcctctaga

SEQ ID NO: 127739 - DNA, 25 bp, mus musculus
tgggtacgaccagccagcatggtcc

SEQ ID NO: 127740 - DNA, 25 bp, mus musculus
gccagcatggtccactgcccgcgga

SEQ ID NO: 127741 - DNA, 25 bp, mus musculus
cggagacacacacccagcgagcatt

SEQ ID NO: 127742 - DNA, 25 bp, mus musculus
cacacacccagcgagcattgaacac

SEQ ID NO: 127743 - DNA, 25 bp, mus musculus
acacccagcgagcattgaacactgc

SEQ ID NO: 127744 - DNA, 25 bp, mus musculus
cattgaacactgcacacggccgtct

SEQ ID NO: 127745 - DNA, 25 bp, mus musculus
tgaacactgcacacggccgtctgcc

SEQ ID NO: 127746 - DNA, 25 bp, mus musculus
gcttcatctgtcgttgtcccccagg

SEQ ID NO: 127747 - DNA, 25 bp, mus musculus
agtgtatccacactgactcgggacc

SEQ ID NO: 127748 - DNA, 25 bp, mus musculus
tctgtgacgaggcctgcaatagtca

SEQ ID NO: 127749 - DNA, 25 bp, mus musculus
atagtcatgcctgccagtgggatgg

SEQ ID NO: 127750 - DNA, 25 bp, mus musculus
ccactcttcgctgctgggaatacat

SEQ ID NO: 127751 - DNA, 25 bp, mus musculus
ttcgctgctgggaatacatcaacaa

SEQ ID NO: 127752 - DNA, 25 bp, mus musculus
aatacatcaacaaccagtgtgatga

SEQ ID NO: 127753 - DNA, 25 bp, mus musculus
tcaacaaccagtgtgatgagcagtg

SEQ ID NO: 127754 - DNA, 25 bp, mus musculus
gcaacaccgcagagtgcctgtttga

SEQ ID NO: 127755 - DNA, 25 bp, mus musculus
ccgcagagtgcctgtttgacaactt

SEQ ID NO: 127756 - DNA, 25 bp, mus musculus
actgtgcagaccacttcaaagacaa

SEQ ID NO: 127757 - DNA, 25 bp, mus musculus
cagaccacttcaaagacaaccactg

SEQ ID NO: 127758 - DNA, 25 bp, mus musculus
gcttctgcctgaaccccaaggactg

SEQ ID NO: 127759 - DNA, 25 bp, mus musculus
cttcaaagacaaccactgtgatcag

SEQ ID NO: 127760 - DNA, 25 bp, mus musculus
gcctgaaccccaaggactgcgagtc

SEQ ID NO: 127761 - DNA, 25 bp, mus musculus
accccaaggactgcgagtcaggatg

SEQ ID NO: 127762 - DNA, 25 bp, mus musculus
agcatgggggcacctgctatcctca

SEQ ID NO: 127763 - DNA, 25 bp, mus musculus
ggggcacctgctatcctcagcgcca

SEQ ID NO: 127764 - DNA, 25 bp, mus musculus
gcagccactgcgaactctacacagc

SEQ ID NO: 127765 - DNA, 25 bp, mus musculus
agagtcagtactgcgccgacaaggc

SEQ ID NO: 127766 - DNA, 25 bp, mus musculus
agtactgcgccgacaaggctcggga

SEQ ID NO: 127767 - DNA, 25 bp, mus musculus
acccagtctacaggttctccacaag

SEQ ID NO: 127768 - DNA, 25 bp, mus musculus
tctacaggttctccacaagcccagc

SEQ ID NO: 127769 - DNA, 25 bp, mus musculus
tctggcgcagatcccattggaatcc

SEQ ID NO: 127770 - DNA, 25 bp, mus musculus
gcagatcccattggaatcccgagcc

SEQ ID NO: 127771 - DNA, 25 bp, mus musculus
ccactcttccttcagacttagatgc

SEQ ID NO: 127772 - DNA, 25 bp, mus musculus
ttccttcagacttagatgctgccta

SEQ ID NO: 127773 - DNA, 25 bp, mus musculus
cagacttagatgctgcctatgaggc

SEQ ID NO: 127774 - DNA, 25 bp, mus musculus
tagatgctgcctatgaggctcacaa

SEQ ID NO: 127775 - DNA, 25 bp, mus musculus
ctgcctatgaggctcacaacacgga

SEQ ID NO: 127776 - DNA, 25 bp, mus musculus
tccaagcaggctacccaaaggggat

SEQ ID NO: 127777 - DNA, 25 bp, mus musculus
ttgatgcagctgtttttgaaaagga

SEQ ID NO: 127778 - DNA, 25 bp, mus musculus
aaggcttcccaagacagataacaga

SEQ ID NO: 127779 - DNA, 25 bp, mus musculus
agggcattcaatccctgtatggagc

SEQ ID NO: 127780 - DNA, 25 bp, mus musculus
ttcaatccctgtatggagccggtcc

SEQ ID NO: 127781 - DNA, 25 bp, mus musculus
ctgtgttgtctgtctctccaagacc

SEQ ID NO: 127782 - DNA, 25 bp, mus musculus
tctctccaagacctgagaccacaga

SEQ ID NO: 127783 - DNA, 25 bp, mus musculus
ctgagaccacagacaaatgtgatcc

SEQ ID NO: 127784 - DNA, 25 bp, mus musculus
gtgatcctgctttgtccttcgattc

SEQ ID NO: 127785 - DNA, 25 bp, mus musculus
tgtccttcgattcagtcaacacgct

SEQ ID NO: 127786 - DNA, 25 bp, mus musculus
tcgattcagtcaacacgctgagagg

SEQ ID NO: 127787 - DNA, 25 bp, mus musculus
gcagacctcaaaccacgaaacatcc

SEQ ID NO: 127788 - DNA, 25 bp, mus musculus
gactttggactcagcttcaaagaag

SEQ ID NO: 127789 - DNA, 25 bp, mus musculus
aaggcaaacagttctgctattattg

SEQ ID NO: 127790 - DNA, 25 bp, mus musculus
atatttgccagtaaagcagtggtga

SEQ ID NO: 127791 - DNA, 25 bp, mus musculus
aatgccgcaattccagcctatcacc

SEQ ID NO: 127792 - DNA, 25 bp, mus musculus
tatcacctcagagaccttatcaaaa

SEQ ID NO: 127793 - DNA, 25 bp, mus musculus
ctcagagaccttatcaaaagcatgc

SEQ ID NO: 127794 - DNA, 25 bp, mus musculus
cttcatgatgacccgggcagaagaa

SEQ ID NO: 127795 - DNA, 25 bp, mus musculus
agaagaatccctgctgagatggcat

SEQ ID NO: 127796 - DNA, 25 bp, mus musculus
agcattccttttgcccctcatattg

SEQ ID NO: 127797 - DNA, 25 bp, mus musculus
ccttttgcccctcatattgaagatc

SEQ ID NO: 127798 - DNA, 25 bp, mus musculus
gcccctcatattgaagatctggtga

SEQ ID NO: 127799 - DNA, 25 bp, mus musculus
ggactcagcttcaaagaaggcaatc

SEQ ID NO: 127800 - DNA, 25 bp, mus musculus
tatattcagacagacgggtatcgcg

SEQ ID NO: 127801 - DNA, 25 bp, mus musculus
tatcgcgctcctgaagcagagctgc

SEQ ID NO: 127802 - DNA, 25 bp, mus musculus
gctcctgaagcagagctgcagaact

SEQ ID NO: 127803 - DNA, 25 bp, mus musculus
cagaactgcttggcccaggccggcc

SEQ ID NO: 127804 - DNA, 25 bp, mus musculus
tgtacctcagctgttgatctgtgga

SEQ ID NO: 127805 - DNA, 25 bp, mus musculus
tcagctgttgatctgtggagcctcg

SEQ ID NO: 127806 - DNA, 25 bp, mus musculus
ctgtggagcctcggaatcattttac
